(12) United States Patent
De Fougerolles et al.

(10) Patent No.: US 7,919,473 B2
(45) Date of Patent: *Apr. 5, 2011

(54) IRNA AGENTS TARGETING VEGF

(75) Inventors: Antonin De Fougerolles, Brookline, MA (US); Maria Frank-Kamenetsky, Brookline, MA (US); Muthiah Manoharan, Weston, MA (US); Kallanthottathil G. Rajeev, Cambridge, MA (US); Philipp Hadwiger, Altenkunstadt (DE)

(73) Assignee: Alnylam Pharmaceuticals, Inc., Cambridge, MA (US)

( * ) Notice: Subject to any disclaimer, the term of this patent is extended or adjusted under 35 U.S.C. 154(b) by 0 days.

This patent is subject to a terminal disclaimer.

(21) Appl. No.: 11/340,080

(22) Filed: Jan. 25, 2006

(65) Prior Publication Data
US 2006/0223770 A1 Oct. 5, 2006

Related U.S. Application Data

(63) Continuation-in-part of application No. 11/078,073, filed on Mar. 11, 2005.

(60) Provisional application No. 60/552,620, filed on Mar. 12, 2004, provisional application No. 60/559,824, filed on Apr. 5, 2004, provisional application No. 60/647,191, filed on Jan. 25, 2005.

(51) Int. Cl.
A61K 31/70 (2006.01)
C07H 21/04 (2006.01)

(52) U.S. Cl. .......................................... 514/44; 536/24.5

(58) Field of Classification Search .................. None
See application file for complete search history.

(56) References Cited

U.S. PATENT DOCUMENTS

| | | |
|---|---|---|
| 4,426,330 A | 1/1984 | Sears |
| 4,534,899 A | 8/1985 | Sears |
| 4,837,028 A | 6/1989 | Allen |
| 4,868,116 A | 9/1989 | Morgan et al. |
| 4,980,286 A | 12/1990 | Morgan et al. |
| 5,013,556 A | 5/1991 | Woodle et al. |
| 5,139,941 A | 8/1992 | Muzyczka et al. |
| 5,213,804 A | 5/1993 | Martin et al. |
| 5,225,212 A | 7/1993 | Martin et al. |
| 5,252,479 A | 10/1993 | Srivastava |
| 5,264,221 A | 11/1993 | Tagawa et al. |
| 5,328,470 A | 7/1994 | Nabel et al. |
| 5,334,711 A | 8/1994 | Sproat et al. |
| 5,356,633 A | 10/1994 | Woodle et al. |
| 5,540,935 A | 7/1996 | Miyazaki et al. |
| 5,543,152 A | 8/1996 | Webb et al. |
| 5,556,948 A | 9/1996 | Tagawa et al. |
| 5,595,760 A | 1/1997 | Cherif-Cheikh |
| 5,627,053 A | 5/1997 | Usman et al. |
| 5,665,710 A | 9/1997 | Rahman et al. |
| 5,672,659 A | 9/1997 | Shalaby et al. |
| 5,705,188 A | 1/1998 | Junichi et al. |
| 5,716,824 A | 2/1998 | Beigelman et al. |
| 5,854,038 A | 12/1998 | Sullenger et al. |
| 5,902,880 A | 5/1999 | Thompson |
| 6,054,299 A | 4/2000 | Conrad |
| 6,146,886 A | 11/2000 | Thompson |
| 6,150,092 A * | 11/2000 | Uchida et al. ..................... 435/6 |
| 6,395,713 B1 | 5/2002 | Beigelman et al. |
| 2003/0203844 A1 | 10/2003 | Delfani et al. |
| 2004/0018176 A1* | 1/2004 | Tolentino et al. .......... 424/93.21 |
| 2004/0180847 A1 | 9/2004 | Dobie et al. |
| 2004/0209832 A1* | 10/2004 | McSwiggen et al. ........... 514/44 |
| 2005/0255487 A1* | 11/2005 | Khvorova et al. ................ 435/6 |
| 2007/0031844 A1* | 2/2007 | Khvorova et al. ................ 435/6 |

FOREIGN PATENT DOCUMENTS

| | | |
|---|---|---|
| DE | 10100586 | 4/2002 |
| WO | WO 89/02468 | 3/1989 |
| WO | WO 89/05345 | 6/1989 |
| WO | WO 89/07136 | 8/1989 |
| WO | WO 92/07065 | 4/1992 |
| WO | WO 92/07573 | 5/1992 |
| WO | WO 93/15187 | 8/1993 |
| WO | WO 93/23569 | 11/1993 |
| WO | WO 93/24641 | 12/1993 |
| WO | WO 94/02595 | 2/1994 |
| WO | WO 94/13788 | 6/1994 |
| WO | WO 96/10390 | 4/1996 |
| WO | WO 96/10391 | 4/1996 |
| WO | WO 96/10392 | 4/1996 |
| WO | WO 96/40062 | 12/1996 |
| WO | WO 97/26270 | 7/1997 |
| WO | WO 98/13526 | 4/1998 |
| WO | WO 99/61631 | 2/1999 |
| WO | WO 99/32619 | 7/1999 |
| WO | WO 99/53050 | 10/1999 |
| WO | WO 00/22113 | 4/2000 |
| WO | WO 00/22114 | 4/2000 |
| WO | WO 00/44895 | 8/2000 |
| WO | WO 00/53722 | 9/2000 |
| WO | WO 03/070910 | 8/2003 |
| WO | WO 03/070918 A | 8/2003 |
| WO | WO 2004/001193 | 12/2003 |
| WO | WO 2004/007070 | 1/2004 |
| WO | WO 2004/011829 | 2/2004 |
| WO | WO 2004/011822 | 5/2004 |
| WO | WO 2004/064737 | 8/2004 |
| WO | WO 2004/080406 | 9/2004 |
| WO | WO 2004/094345 | 11/2004 |
| WO | WO 2004/094595 | 11/2004 |
| WO | WO 2004/099410 A2 | 11/2004 |
| WO | WO 2005/014782 A | 2/2005 |

OTHER PUBLICATIONS

Vickers et al. (2003) J. Biol. Chem. 278:7108-7118.* Elbashir et al. (2001) Nature 411:494-498.*
Bass (2001) Nature 411:428-9.*
Fattal et al. (2006) Advanced Drug Delivery Reviews 58:1203-1223.*
Holen et al. (2002) Nucleic Acids Res. 8:1757-1766.*

(Continued)

Primary Examiner — Tracy Vivlemore
(74) Attorney, Agent, or Firm — Fenwick & West LLP

(57) ABSTRACT

The features of the present invention relate to compounds, compositions and methods useful for modulating the expression of vascular endothelial growth factor (VEGF), such as by the mechanism of RNA interference (RNAi). The compounds and compositions include iRNA agents that can be unmodified or chemically-modified.

7 Claims, 65 Drawing Sheets

OTHER PUBLICATIONS

Akhtar et al, "Cellular uptake and intracellular fate of antisense oligonucleotides" *Trends Cell Biol.* 2:139-144(1992).

Aldrian-Herrada et al., "A peptide nucleic acid (PNA) is more rapidly internalized in cultured neurons when coupled to a *retro-inverso* delivery peptide. The antisense activity depresses the target mRNA and protein in magnocellular oxytocin neurons" *Nucleic Acids Res.* 26:4910-4916 (1998).

Beigelman et al., "Chemical Modification of Hammerhead Ribozymes" *J. Biol. Chem.* 270:25702-25708 (1995).

Bernstein et al., "Role for a bidentate ribonuclease in the initiation step of RNA interference" *Nature* 409:363-366 (2001).

Boado, "Antisense drug delivery through the blood-brain barrier" *Adv. Drug. Deliv. Rev.* 15:73-107 (1995).

Boado et al., "Drug Delivery of Antisense Molecules to the Brain for Treatment of Alzheimer's Disease and Cerebral AIDS" *J. Pharm. Sci.* 87:1308-1315 (1998).

Burgin, Jr. et al., "Chemically Modified Hammerhead Ribozymes with Improved Catalytic Rates" *Biochemistry* 35:14090-14097 (1996).

Burlina et al., "Chemical Engineering of RNase Resistant and Catalytically Active Hammerhead Ribozymes"*Bioorg. Med. Chem.* 5:1999-2010 (1997).

Chen et al., "Multitarget-ribozyme directed to cleave at up to nine highly conserved HIV-1 env RNA regions inhibits HIV-1 replication—potential effectiveness against most presently sequenced HIV-1 isolates" *Nucleic Acids Res.* 20:4581-4589 (1992).

Chowrira et al., "In Vitro and in Vivo Comparison of Hammerhead, Hairpin, and Hepatitis Delta Virus Self-processing Ribozyme Cassettes" *J. Biol. Chem.* 269:25856-25864 (1994).

Couture et al., "Anti-gene therapy: the use of ribozymes to inhibit gene function" *Trends Genet.* 12:510-515 (1996).

Dropulić et al., "Functional Characterization of a U5 Ribozyme: Intracellular Suppression of Human Immunodeficiency Virus Type 1 Expression" *J. Virol.* 66:1432-1441 (1992).

Dunn et al., "ARPE-19, A Human Retinal Pigment Epithelial Cell Line with Differentiated Properties" *Exp. Eye Res.* 62:155-169 (1996).

Earnshaw et al., "Modified Oligoribonucleotides as Site-Specific Probes of RNA Structure and Function" *Biopolymers* 48:39-55 (1998).

Elbashir et al., "Duplexes of 21-nucleotide RNAs mediate RNA interference in cultured mammalian cells" *Nature* 411:494-498 (2001).

Elbashir et al., "RNA interference is mediated by 21- and 22-nucleotide RNAs" *Genes Dev.* 15:188-200 (2001).

Filleur et al., "SiRNA-mediated Inhibition of Vascular Endothelial Growth Factor Severely Limits Tumor Resistance to Antiangiogenic Thrombospondin-1 and Slows Tumor Vascularization and Growth" *Cancer Res.* 63:3919-3922 (2003).

Fire et al., "Potent and specific genetic interference by double-stranded RNA in *Caenorhabditis elegans*" *Nature* 391:806-811 (1998).

GenBank Accession No. AF214570, "*Homo sapiens* vascular endothelial growth factor isoform 121 precursor, mRNA, complete cds" Dec. 23, 1999.

Gonzalez et al., "New Class of Polymers for the Delivery of Macromolecular Therapeutics" *Bioconjug. Chem.* 10:1068-1074 (1999).

Good et al., "Expression of small, therapeutic RNAs in human cell nuclei" *Gene Ther.* 4:45-54 (1997).

Hofland et al., "Chapter 8: Formulation and Delivery of Nucleic Acids" *Novel Therapeutics from Modern Biotechnology: From Laboratory to Human Testing*, Edited by Dale L. Oxender and Leonard E. Post, Springer-Verlag Berlin Heidelberg, pp. 165-192 (1999).

Ishiwata et al, "Physical-Chemistry Characteristics and Biodistribution of Poly(ethylene glycol)-Coated Liposomes Using Poly(oxyethylene) Cholesteryl Ether" *Chem. Pharm. Bull.* (Tokyo) 43:1005-1011 (1995).

Izant et al., "Constitutive and Conditional Suppression of Exogenous and Endogenous Genes by Anti-Sense RNA" *Science* 229:345-352 (1985).

Jolliet-Riant et al., "Drug transfer across the blood-brain barrier and improvement of brain delivery" *Fundam. Clin. Pharmacol.* 13:16-26 (1999).

Karpeisky et al., "Highly Efficient Synthesis of 2'-*O*-Amino Nucleosides And Their Incorporation In Hammerhead Ribozymes" *Tetrahedron Lett.* 39:1131-1134 (1998).

Kashani-Sabet et al., "Reversal of the Malignant Phenotype by an Anti-*ras* Ribozyme" *Antisense Res. Dev.* 2:3-15 (1992).

Kawasaki et al., "Uniformly Modified 2'-Deoxy-2'-fluoro Phosphorothioate Oligonucleotides as Nuclease-Resistant Antisense Compounds with High Affinity and Specificity for RNA Targets" *J. Med. Chem.* 36:831-841 (1993).

Kumar et al., "Express protocol for functionalization of polymer supports for oligonucleotide synthesis" *Nucleosides & Nucleotides* 15:879-888 (1996).

Lasic et al., "Liposomes Revisited" *Science* 267:1275-1276 (1995).

Lasic et al., "The 'Stealth' Liposome: A Prototypical Biomaterial" *Chem. Rev.* 95:2601-2628 (1995).

Lee et al., "Chapter 18: Modified Liposome Formulations for Cytosolic Delivery of Macromolecules" *Controlled Drug Delivery: Designing Technologies for the Future*, Edited by Kinam Park and Randall J. Mrsny, Oxford University Press, pp. 184-192 (2000).

Liu et al., "Cationic Liposome-mediated Intravenous Gene Delivery" *J. Biol. Chem.* 270 24864-24870 (1995).

Maurer et al., "Lipid-based systems for the intracellular delivery of genetic drugs" *Mol. Membr. Biol.* 16:129-140 (1999).

McGarry et al., "Inhibition of heat shock protein synthesis by heat-inducible antisense RNA" *Proc. Natl. Acad. Sci.* USA 83:399-403 (1986).

Nykänen et al., "ATP Requirements and Small Interfering RNA Structure in the RNA Interference Pathway" *Cell* 107:309-321 (2001).

Ohkawa et al., "Activities of HIV-RNA targeted ribozymes transcribed from a 'shot-gun' type ribozyme-trimming plasmid" *Nucleic Acids Symp. Ser.* No. 27, pp. 15-16 (1992).

Ojwang et al., "Inhibition of human immunodeficiency virus type 1 expression by a hairpin ribozyme" *Proc. Natl. Acad. Sci.* USA 89:10802-10806 (1992).

Oku et al., "Real-time analysis of liposomal trafficking in tumor-bearing mice by use of positron emission tomography" *Biochim. Biophys. Acta* 1238:86-90 (1995).

Pardridge et al., "Vector-mediated delivery of a polyamide ('peptide') nucleic acid analogue through the blood-brain barrier in vivo" *Proc. Natl. Acad. Sci.* USA 92:5592-5596 (1995).

Perreault et al., "Mixed deoxyribo- and ribo-oligonucleotides with catalytic activity" *Nature* 344:565-567 (1990).

Pieken et al., "Kinetic Characterization of Ribonuclease-Resistant 2'-Modified Hammerhead Ribozymes" *Science* 253:314-317 (1991).

Prakash et al., "Synthesis of 2'-*O*-[2-[(*N,N*=Dimethylamino)oxy]ethyl] Modified Nucleosides and Oligonucleotides" *J. Org. Chem.* 67:357-369 (2002).

Reich et al., "Small interfering RNA (siRNA) targeting *VEGF* effectively inhibits ocular neovascularization in a mouse model" *Mol. Vis.* 9:210-216 (2003).

Sarver et al., "Ribozymes as Potential Anti-HIV-1 Therapeutic Agents" *Science* 247:1222-1225 (1990).

Scanlon et al., "Ribozyme-mediated cleavage of c-fos mRNA reduces gene expression of DNA synthesis enzymes and metallothionein" *Proc. Natl. Acad. Sci.* USA 88:10591-10595 (1991).

Taira et al, "Construction of a novel RNA-transcript-trimming plasmid which can be used both in vitro in place of run-off and (G)-free transcriptions and in vivo as multi-sequences transcription vectors" *Nucleic Acids Res.* 19:5125-5130 (1991).

Thompson et al., "Improved accumulation and activity of ribozymes expressed from a tRNA-based RNA polymerase III promoter" *Nucleic Acids Res.* 23:2259-2268 (1995).

Tyler et al., "Peptide nucleic acids targeted to the neurotensin receptor and administered i.p. cross the blood-brain barrier and specifically reduce gene expression" *Proc. Natl. Acad. Sci.* USA 96:7053-7058 (1999).

Tyler et al., "Specific gene blockade shows that peptide nucleic acids readily enter neuronal cells in vivo" *FEBS Lett.* 421:280-284 (1998).

Usman et al., "Chemical modification of hammerhead ribozymes: activity and nuclease resistance" Nucleic Acids Symp. Ser. No. 31, pp. 163-164 (1994).

Usman et al., "Exploiting the chemical synthesis of RNA" Trends Biochem. Sci. 17:334-339 (1992).

Ventura et al., "Activation of HIV-specific ribozyme activity by self-cleavage" Nucleic Acids Res. 21:3249-3255 (1993).

Verma et al., "Modified Oligonucleotides: Synthesis and Strategy for Users" Annu. Rev. Biochem. 67:99-134 (1998).

Vickers et al., "Efficient Reduction of Target RNAs by Small Interfering RNA and RNase H-dependent Antisense Agents" J. Biol. Chem. 278:7108-7118 (2003).

Weerasinghe et al., "Resistance to Human Immunodeficiency Virus Type 1 (HIV-1) Infection in Human CD4+ Lymphocyte-Derived Cell Lines Conferred by Using Retroviral Vectors Expressing an HIV-1 RNA-Specific Ribozyme" J. Virol. 65:5531-5534 (1991).

Wincott et al., "Synthesis, deprotection, analysis and purification of RNA and ribozymes" Nucleic Acids Res. 23:2677-2684 (1995).

Boese et al., "Mechanical Insights Aid Computational Short Interfering RNA Design," Methods in Enzymology 392:73-96, 2005.

Reynolds et al., "Rational siRNA design for RNA interference," Nature Biotechnology 22:326-330, 2004.

Anderson et al., "Human Gene Therapy," Nature, 392 (Suppl): 25-30 (1998).

Armentano et al., "Expression of Human Facot IX in Rabbit Hepatocytes by Retrovirus-Mediated Gene Transfer: Potential for Gene Therapy of hemophilia B" Proc. Natl. Acad. Sci. USA 87: 6141-6145 (1990).

Berkner, K., "Development of Adenovirus Vectors for the Expression of Heterologous Genes,"BiotechnIques, 6(7): 616-629 (1988).

Bucchini et al., "Pancreatic Expression in Human Insulin Gene in Transgenic Mice" Proc. Natl. Acad. Sci. USA, 83: 2511-2515 (1986).

Chen et al., "Gene Therapy for Brain Tumors: Regression of Experimental Gliomas by Adenovirus-Mediated Gene Transfer in vivo", Proc. Nat!. Acad. Sci. USA, 91: 3054-3057 (1994).

Chowdhury et al., "Long-Term Improvements of Hypercholesterolemia After ex Vivo Gene Therapy in LDLR-Deficient Rabbits," Science, 254(5039): 1802-1805 (1991).

Cone, R. and Mulligan, R, "High-Efficiency Gene Transfer into Mammalian Cells: Generation of Helper-Free Recombinant Retrovirus with Broad Mammalian Host Range," Proceedings of the National Academy of Sciences of the United States of America.

Cometta et al., "Safety Issues Related to Retroviral-Mediated Gene Transfer in Humans," Human Gene Therapy 2:5-14 (1991).

Couture et al., "Anti-Gene Therapy: The Use of Ribozyrnes to Inhibit Gene Function" TGI 12(12):510-515 (1996).

Crooke et al., "Pharmacokinetic Properties of Several Novel Oligonucleotide Analogs in Mice" The Journal of Pharmacology and Experimental Therapeutics, 277(2): 923-937 (1996).

Dai et al., "Gene Therapy Via Primary Myoblasts: Long-Term Expression of Factor IX Protein Following Transplantation in vivo" Proc. Natl. Acad. Sci. USA, 89: 10892-10895 (1992).

Danos, O. and Mulligan, R., "Safe and Efficient Generation of Recombinant Retroviruses with Arnphotropic and Ecotropic Host Ranges" Proc. Natl. Acad. Sci. USA, 85: 6460-6464 (1988).

Docherty, K. and Clark, A., "Nutrient Regulation ofInsulin Gene Expression," The FASEB Journal 8: 20-27 (1994).

Domburg, R., "Reticuloendotheliosis Viruses and Derived Vectors," Gene Therapy, 2:301-310 (1995).

Eglitis et al., "Gene Expression in Mice After High Efficiency Retroviral-Mediated Gene Transfer," Science 230(4732): 1395-1398 (1995).

Eglitis et al., "Retroviral Vectors for Introductions of Genes into Mammalian Cells," Bio techniques 6:608-614 (1988).

Elbashir et al., "Functional Anatomy of siRNAs for Mediating Efficient RNAi in Drosophila melano~atser embryo lysate" The EMBO Journal 20(23): 6877-6888 (2001).

El-Hariri et al., "The Mitigating Effects of Phosphatidylcholines on Bile Salt- and Lysophosphatidylcholine-Induced Membrane Damage," J Pharm. Pharmacal., 44:651-654 (1992).

Ferry et al., "Retroviral-Mediated Gene Transfer into Hepatocytes in vivo" Proc. Natl. Acad. Sci. USA, 88:8377-8381 (1991).

Fisher et al., "Transduction with Recombinant Adeno-Associated Virus for Gene Therapy is Limited by Leading-Strand Synthesis," Journal of Virology, 70:520-532 (1996).

Gassmann et al., "Maintenance of an Extrachromosomal Plasmid Vector in Mouse Embryonic Stem Cells" Froc. Nat!. Acad. Sci. USA, 92: 1292-1296 (1995).

Hsu et al., "Immunogenicity of Recombinant Adenovirus-Respiratory Syncytial Virus Vaccines with Adenovirus Types 4,5, and 7 Vectors in Dogs and Chimpanzee," The Journal of Infectious Diseases 166:769-775 (1992).

Huber et al., "Retroviral-Mediated Gene Therapy for the Treatment of Hepatocellular Carcinoma: An Innovative Approach for Cancer Therapy" Proc. Natl. Acad. Sci. USA, 88: 8039-8043 (1991).

Hwu et al., "Functional and Molecular Characterization of Tumor-Infiitrating Lymphocytes CS Transduped with Tumor Necrosis Factor-a eDNA for the Gene Therapy of Cancer in Humans," The Journal of Immunology 150: 4104-4115 (1993).

Kabanov et al., "A New Class of Antivirals: Antisense Oligonucleotides Combined with a Hydrophobic Substituent Effictively Inhibit Influenza Virus Reproduction and Synthesis of Virus-Specific Proteins in MDCK Cells" FEB 259(2): 327-330 (1990).

Kay et al., "Hepatic Gene Therapy: Persistent Expression of Human al-Antitypsin in Mice after Direct Gerte Delivery in Vivo," Human Gene Therapy 3: 641-647 (1992).

Lee et al., "Mucosal Penetration Enhancers for Facilitation of Peptide and Protein Drug Absorption," Critical Reviews in Therapeutic Drug Carrier Systems, 8:91-192 (1991).

Manoharan et al., "Chemical Modifications to Improve Uptake and Bioavailability of Anisense Oligonucleotides", Annals of the New York Academy of Sciences, 660: 306-308 (1992).

Martin, Pierre, "Streoselektive Sytheses von 2'-o-(2-Methoxyethyl) ribonucleosiden: Nachbargruppenbeteiligung der Methoxyethoxy-Gruppe bei der Ribosylierung von Heterocyclen," Helvetica Chimica Acta 79: 1930-1938 (1996).

Miller, Dusty A., "Retrovirus Packaging Cells," Human Gene Therapy, 1:5-14 (1990).

Mishra et al., "Improved Leishmanicidal Effect of Phosphorotioate Antisense Oligonucleotides by LDL-Mediated Delivery" Biochimica et Biophysica Acta 1264: 229-237 (1995).

Miyao et al., "Stability and Pharmacokinetic Characteristics of Oligonucleotides Modified at Terminal Linkages in Mice," Antisense Research and Development, 5:115-121 (1995).

Muranishi, S., "Absorption Enhancers," Critical Reviews in Therapeutic Drug Carrier Systems, 7(1): 1-33 (1990).

Muzyczka, N., "Use of Adeno-Associated Virus as a General Transduction Vector for Mammalian Cells," Current Topics in Microbiology and Immunology, 158: 97-129 (1992).

Rabinowitz et al., "Cross-Packaging of a Single Adeno-Associated Virus (AAV) Type 2 Vector Genome into Muliple AAV Serotypes Enables Transduction with Broad Specificity," Journal of Virology, 76:791-701 (2002).

Rosenfeld et al., "In Vivo Transfer of the Human Cystic Fibrosis Transmembrane Conductance Regulator Gene to the Airway Epithelium," Cell 68: 143-155 (1992).

Rubinson et at., "A Lentivirus-Based System to Functionally Silence Genes in Primary Mammalian Cells,.Stem Cells and Transgenic Mice by RNA Interference," Nature Genetics, 33: 401-406 (2003).

Saison-Behmoaras et al., "Short Modified Antisense Oligonucleotides Directed Against Ha-ras Point Mutation Induce Selective Cleavage of the mRNA and Inhibit T24 Cells Proliferation" EMBO J.,10: 1111-1118(1991).

Samulski et at., "A Recombinant Plasmid from Which an Infectious Adeno-Associated Virus Genome: Can be Excised in Vitro and Its Use to Study Viral Replication," Journal of Virology, 61:3096-3101 (1987).

Samulski et al., "Helper-Free Stocks of Recombinant Adeno-Associated Viruses: Normal Integration Does Not Require Viral Gene Expression," Journal of Virology 63:3822-3828 (1989).

Takahashi et al., "The Use of a Perfluorochemical Emulsion as a Vascular Perfusate in Drug Absorption," J. Pharm. Phramacol. 40:252-257 (1988).

Takakura et al., "Uptake Characteristics of Oligonucleotides in the Isolated Rat Liver Perfusion System," Antisense & Nucleic Acid Drug Development 6: 177-183 (1996).

Van Beusechem et al., "Long-Term Expression of Human Adenosine Deaminase in Rhesus Monkeys Transplanted With Retrovirus-Infected Bone-Marrow Cells" Proc. Natl. Acad. Sci. USA, 89: 7640-7644 (1992).

Wilson et al., "Retrovirus-Mediated Transduction of Adult Hepatocytes" Proc. Nat/. Acad. Sci. USA, 85: 3014-3018 (1988).

Xia et al., "siRNA-Mediated Gene Silencing in Vitro and in Vivo," Nature Biotechnology, 20:1006-1010 (2002).

Yang et al., "Evidence That Processed Small dsRNAs May Mediate Sequence-Specific mRNA Degradation during RNAi in Drosophila embryos" Current Biology 10: 1191-1200 (2000).

Hornung, V., et al., "Sequence-specific potent induction of IFN-α by short interfering RNA in plasmacytoid dendritic cells through TLR7," Nature Medicine, Mar. 2005, pp. 263-270, vol. 11, No. 3.

De Fougerolles, A.R., et al., Discovery and development of RNAi Therapeutics, in "Antisense Drug Technologies: Principles, Strategies and Applications, second edition", edited by Crooke, S., Taylor and Francis, 2007, pp. 465-484.

Official Communication from the Examining Division, European Patent Application No. EP 07759825.8, Apr. 23, 2010, 4 Pages.

Supplementary European Search Report, EP 07759825, Sep. 25, 2009, 10 Pages.

Harborth, J., et al., "Sequence, chemical, and structural variation of small interfering RNAs and short hairpin RNAs and the effect on mammalian gene silencing," Antisense & Nucleic Acid Drug Development, Apr. 1, 2003, pp. 83-105, vol. 13, No. 2.

* cited by examiner

```
  1  augaacuuuc ugcugucuug ggugcauugg agccuugccu ugcugcucua ccuccaccau
 61  gccaaguggu cccaggcugc acccauggca gaaggaggag ggcagaauca ucacgaagug
121  gugaaguuca uggaugucua ucagcgcagc uacugccauc caaucgagac ccugguggac
181  aucuuccagg aguacccuga ugagaucgag uacucuuuca agccauccug ugugccccug
241  augcgaugcg ggggcugcug caaugacgag ggccuggagu gugugcccac ugaggagucc
301  aacaucacca ugcagauuau gcggaucaaa ccucaccaag gccagcacau aggagagaug
361  agcuuccuac agcacaacaa augugaaugc agaccaaaga aagauagagc aagacaagaa
421  aaaugugaca agccgaggcg guga  (SEQ ID NO:1)
```

FIG. 1

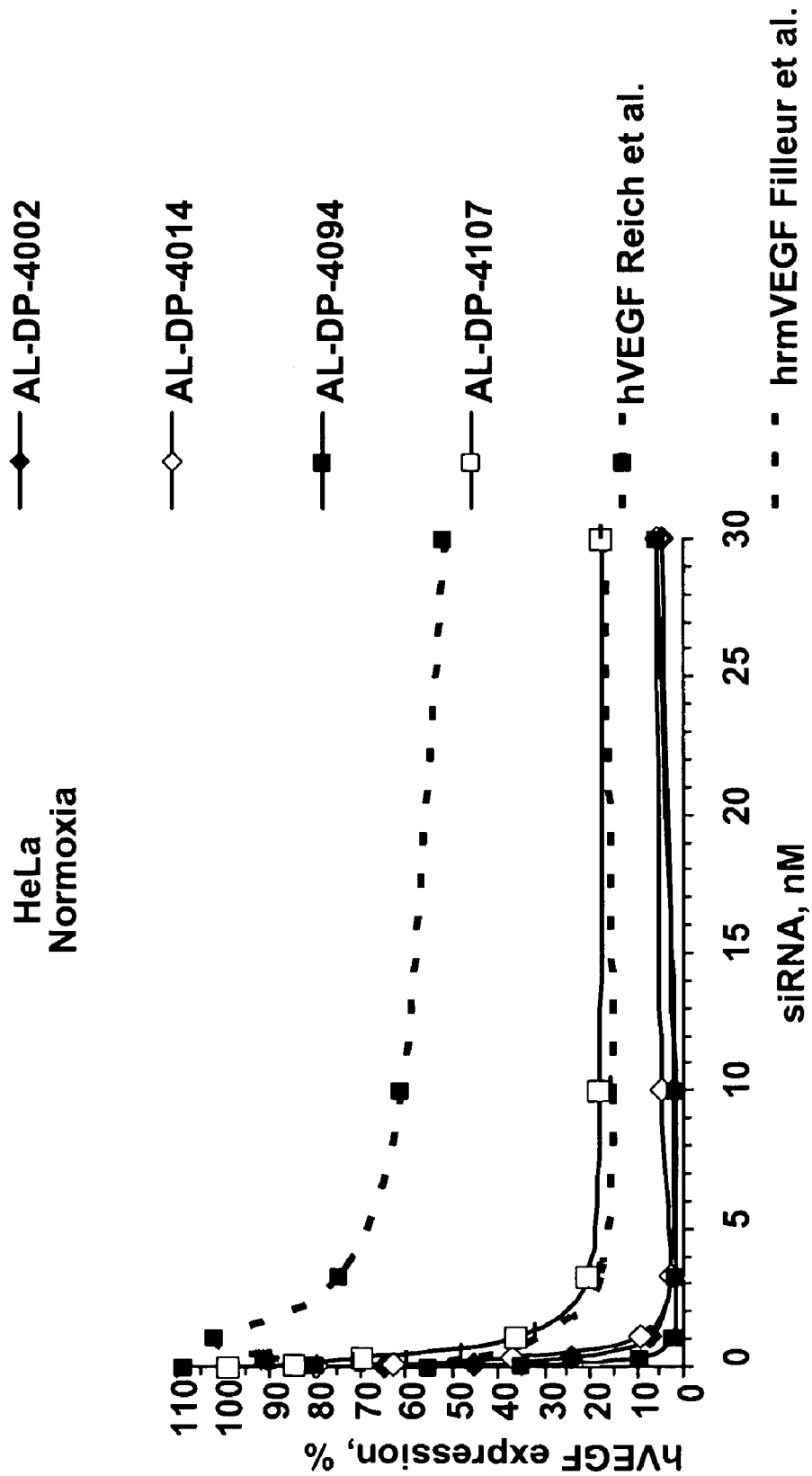

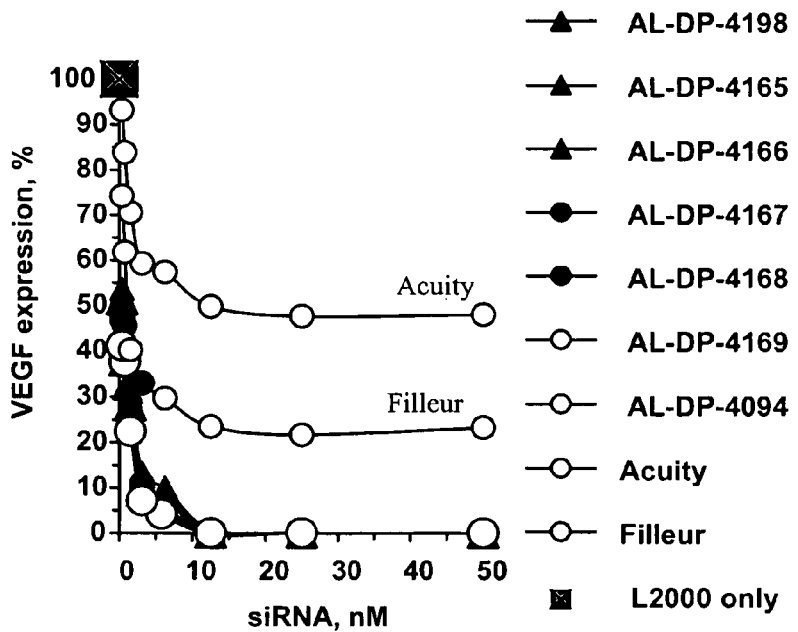

| AL-DP-4198 | 5´- GsCACAUAGGAGAGAUGAGCUsU-3´<br>´3-GsUCGUGUAUCCUCUCUACUCGAsA-´5 |
|---|---|
| AL-DP-4165 | 5´- GsCACAUAGGAGAGAUGAGCUsU-3´<br>´3-GsU$_{OMe}$C$_{OMe}$GUGUAUCCUCUCUACUGAsA-´5 |
| AL-DP-4166 | 5´- GsCACAUAGGAGAGAUGAGCUsU-3´<br>´3-GsU$_{OMe}$C$_{OMe}$GUGUAU$_{OMe}$CCUCUCUACUCGAsA-´5 |
| AL-DP-4167 | 5´- GsCACAUAGGAGAGAUGAGCUsU-3´<br>´3-GsU$_{OMe}$CGU$_{OMe}$GU$_{OMe}$AU$_{OMe}$CCUCUCUAC$_{OMe}$UCGAA-´5 |
| AL-DP-4168 | 5´- GsCACAUAGGAGAGAUGAGCUsU-3´<br>´3-GsU$_{OMe}$C$_{OMe}$GU$_{OMe}$GU$_{OMe}$AU$_{OMe}$CCUCUCUAC$_{OMe}$UCGAA-´5 |
| AL-DP-4169 | 5´- GsCACAUAGGAGAGAUGAGCUsU-3´<br>´3-GsU$_{OMe}$_dCGU$_{OMe}$GU$_{OMe}$AU$_{OMe}$CCUCUCUA_dCUCGAA-´5 |

FIG. 9A

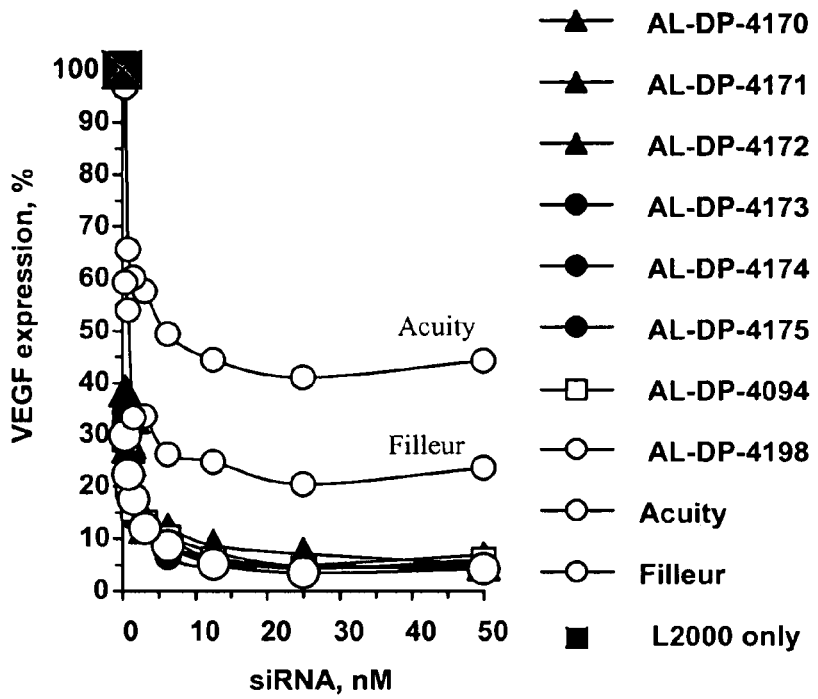

| AL-DP-4170 | 5´- GsCACAU$_{2'OMe}$AGGAGAGAUGAGCUsU-3´<br>´3-GsUCGUGUAUCCUCUCUACUCGAsA -´5 |
|---|---|
| AL-DP-4171 | 5´- GsCACAU$_{2'OMe}$AGGAGAGAUGAGCUsU-3´<br>´3-GsU$_{OMe}$C$_{OMe}$GUGUAUCCUCUCUACUGAsA-´5 |
| AL-DP-4172 | 5´- GsCACAU$_{2'OMe}$AGGAGAGAUGAGCUsU-3´<br>´3-GsU$_{OMe}$C$_{OMe}$GUGUAU$_{OMe}$CCUCUCUACUGAsA-´5 |
| AL-DP-4173 | 5´- GsCACAU$_{2'OMe}$AGGAGAGAUGAGCUsU-3´<br>´3-GsU$_{OMe}$CGU$_{OMe}$GU$_{OMe}$AU$_{OMe}$CCUCUCUAC$_{OMe}$UCGAA-´5 |
| AL-DP-4174 | 5´- GsCACAU$_{2'OMe}$AGGAGAGAUGAGCUsU-3´<br>´3-GsU$_{OMe}$C$_{OMe}$GU$_{OMe}$GU$_{OMe}$AU$_{OMe}$CCUCUCUAC$_{OMe}$UCGAA-´5 |
| AL-DP-4175 | 5´- GsCACAU$_{2'OMe}$AGGAGAGAUGAGCUsU-3´<br>´3-GsU$_{OMe}$_dCGU$_{OMe}$GU$_{OMe}$AU$_{OMe}$CCUCUCUA_dCUCGAA-´5 |

FIG. 9B

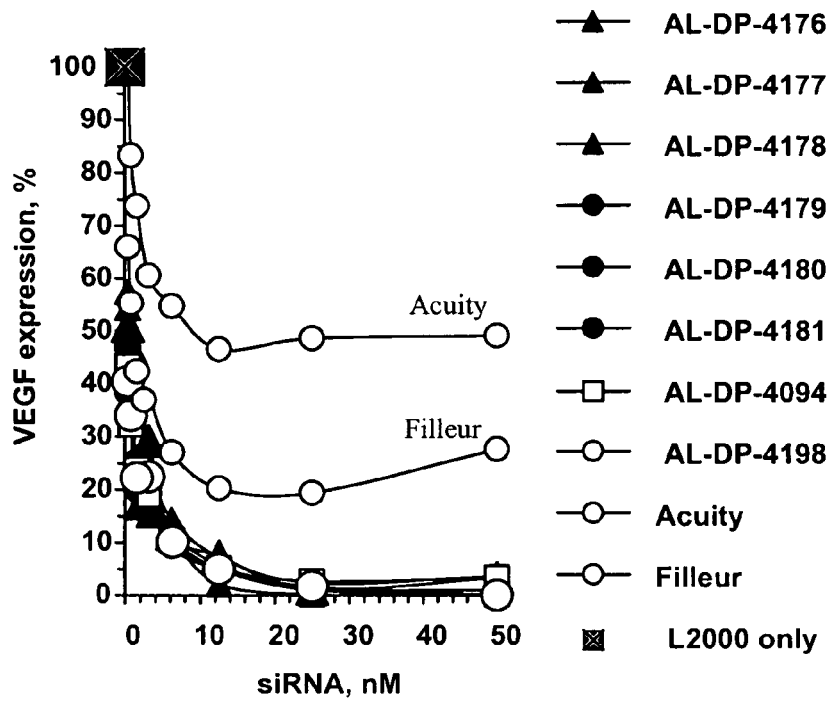

| AL-DP-4176 | 5´-GC$_{OMe}$AC$_{OMe}$AU$_{OMe}$AGGAGAGAU$_{OMe}$GAGCU$_{OMe}$sU-3´<br>´3-GsUCGUGUAUCCUCUCUACUCGAsA-´5 |
|---|---|
| AL-DP-4177 | 5´-GC$_{OMe}$AC$_{OMe}$AU$_{OMe}$AGGAGAGAU$_{OMe}$GAGCU$_{OMe}$sU-3´<br>´3-GsU$_{OMe}$C$_{OMe}$GUGUAUCCUCUCUACUGAsA-´5 |
| AL-DP-4178 | 5´-GC$_{OMe}$AC$_{OMe}$AU$_{OMe}$AGGAGAGAU$_{OMe}$GAGCU$_{OMe}$sU-3´<br>´3-GsU$_{OMe}$C$_{OMe}$GUGUAU$_{OMe}$CCUCUCUACUGAsA-´5 |
| AL-DP-4179 | 5´-GC$_{OMe}$AC$_{OMe}$AU$_{OMe}$AGGAGAGAU$_{OMe}$GAGCU$_{OMe}$sU-3´<br>´3-GsU$_{OMe}$CGU$_{OMe}$GU$_{OMe}$AU$_{OMe}$CCUCUCUAC$_{OMe}$UCGAA-´5 |
| AL-DP-4180 | 5´-GC$_{OMe}$AC$_{OMe}$AU$_{OMe}$AGGAGAGAU$_{OMe}$GAGCU$_{OMe}$sU-3´<br>´3-GsU$_{OMe}$C$_{OMe}$GU$_{OMe}$GU$_{OMe}$AU$_{OMe}$CCUCUCUAC$_{OMe}$UCGAA-´5 |
| AL-DP-4181 | 5´-GC$_{OMe}$AC$_{OMe}$AU$_{OMe}$AGGAGAGAU$_{OMe}$GAGCU$_{OMe}$sU-3´<br>´3-GsU$_{OMe}$—dCGU$_{OMe}$GU$_{OMe}$AU$_{OMe}$CCUCUCUA—dCUCGAA-´5 |

FIG. 9C

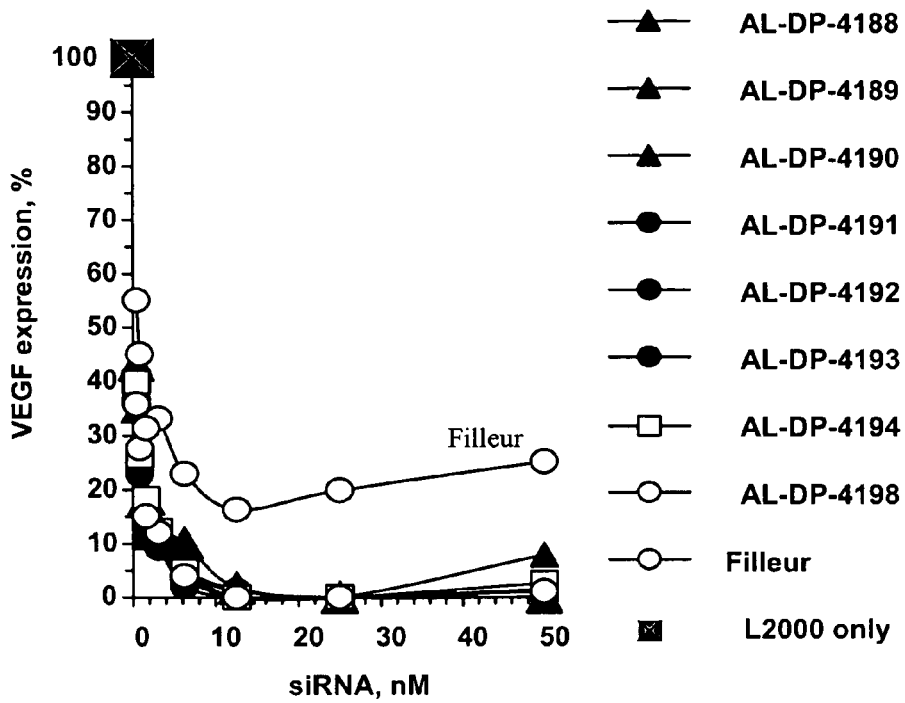

| AL-DP-4188 | 5´-GsCACAU$_{2'F}$AGGAGAGAUGAGCUsU-3´<br>´3-GsUCGUGUAUCCUCUCUACUCGAsA-´5 |
|---|---|
| AL-DP-4189 | 5´-GC$_{2F}$AC$_{2F}$AU$_{2F}$AGGAGAGAU$_{2F}$GAGCU$_{2F}$sU-3´<br>´3-GsUCGUGUAUCCUCUCUACUCGAsA-´5 |
| AL-DP-4190 | 5´-GC$_{2F}$AC$_{2F}$AU$_{OMe}$AGGAGAGAU$_{OMe}$GAGCU$_{OMe}$sU-3´<br>´3-GsUCGUGUAUCCUCUCUACUCGAsA-´5 |
| AL-DP-4191 | 5´-GC$_{OMe}$AC$_{OMe}$AU$_{2F}$AGGAGAGAU$_{2F}$GAGCU$_{2F}$sU-3´<br>´3-GsUCGUGUAUCCUCUCUACUCGAsA-´5 |

| AL-DP-4192 | 5´- GsCACAUAGGAGAGAUGAGCUsU-3´<br>´3-GsU$_{2F}$CGU$_{2F}$GU$_{F2}$AU$_{2F}$CCUCUCUAC$_{2F}$UCGAA-´5 |
|---|---|
| AL-DP-4193 | 5´- GsCACAUAGGAGAGAUGAGCUsU-3´<br>´3-GsU$_{2F}$CGU$_{2F}$GU$_{F2}$AU$_{2F}$CCUCUCUAC$_{OMe}$UCGAA-´5 |
| AL-DP-4194 | 5´- GsCACAUAGGAGAGAUGAGCUsU-3´<br>´3-GsU$_{OMe}$CGU$_{OMe}$GU$_{OMe}$AU$_{OMe}$CCUCUCUAC$_{2F}$UCGAA-´5 |

AL-DUP-4094_120min

5'-GCACAUAGGAGAGAUGAGCU-3'
3'- GUCGUGUAUCCUCUCUACUCGAA-5'

| RT [min] | Strand | 3'-Exo/Endo | cleavage site | Fragment | Phosphate | cal. Mass | exp. Mass | Remarks |
|---|---|---|---|---|---|---|---|---|
| 1,17 | sense | endo | U6 - A7 | 5'- GCACAU | 3-Phosphate | 1920,2 | 1920,0 | + some unidentified masses |
| 10,34 | antisense | endo | U8 - C9 | UACUCGAA-5' | cyclic Phosphate | 2554,5 | 2554,0 | small after 30min - slow kinetics |
| 14,61 | sense | 3-exo of next fragment | | AGGAGAUGAGCU | - | 4571,8 | 4572,0 | |
| 15,85 | sense | endo | U6 - A7 | AGGAGAUGAGCU -3' | - | 4878,0 | 4878,0 | |
| 17,32 | antisense | endo | U15 - A16 | UCCUCUCUACUCGAA-5' | cyclic Phosphate | 4693,8 | 4693,0 | |
| 19,37 | antisense | endo | U15 - A16 | UCCUCUCUACUCGAA-5' | 3-Phosphate | 4711,8 | 4711,0 | not detected after 30min |
| 21,45 | sense | 3-exo | n-1 | 5'-GCACAUAGGAGAGAUGAGCU | - | 6492,0 | 6492,5 | small after 30min |
| 22,16 | sense | FLP | | 5'-GCACAUAGGAGGAGAGAUGAGCU-3' | - | 6798,2 | 6797,5 | only small amounts of as-FLP detected |
| 22,86 | antisense | 3-exo | n-2 | CGUGUAUCCUCUCUACUCGAA-5' | cyclic Phosphate | 6630,9 | 6631,0 | |
| 23,91 | antisense | 3-exo | n-2 | CGUGUAUCCUCUCUACUCGAA-5' | 3-Phosphate | 6648,9 | 6648,0 | not detected after 30min |
| 24,32 | antisense | 3-exo | n-1 | UCGUGUAUCCUCUCUACUCGAA-5' | 3-Phosphate | 6955,1 | 6954,8 | |

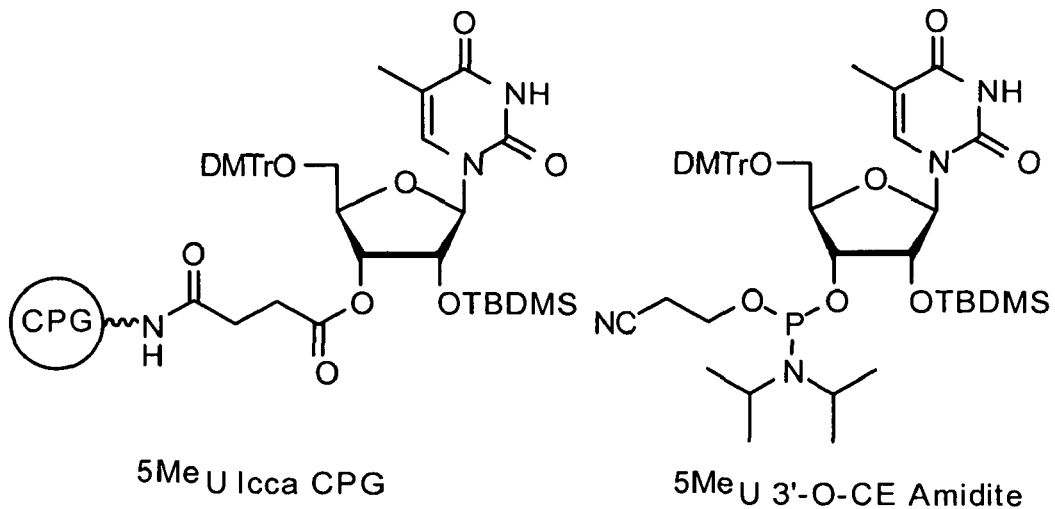
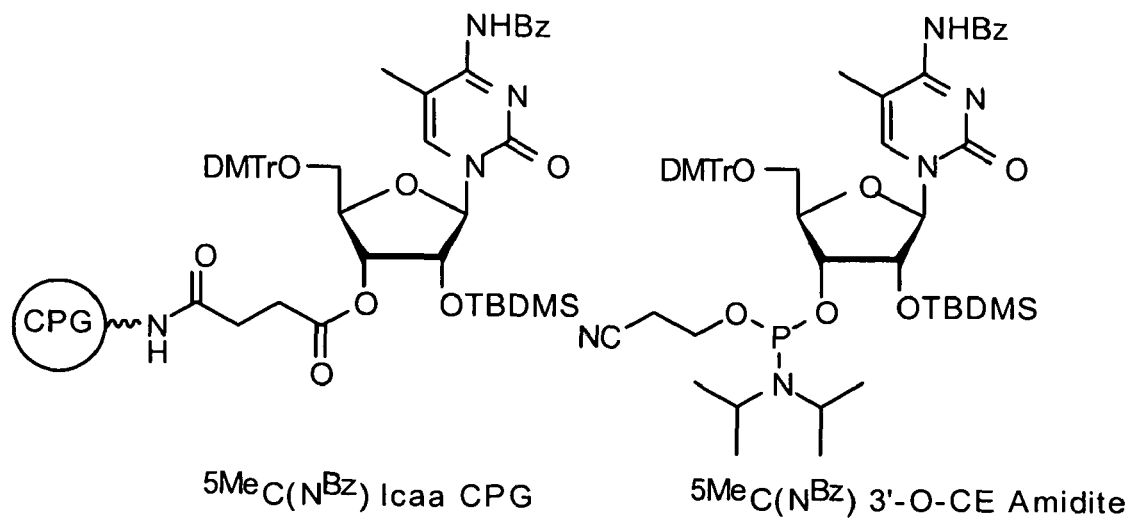
FIG. 41

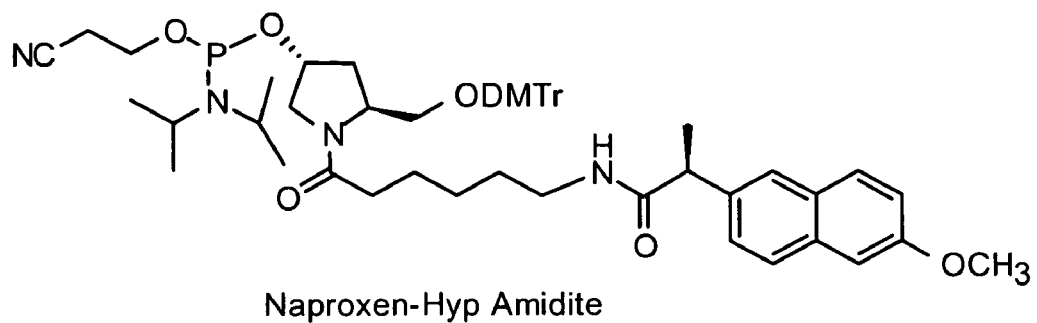
Naproxen-Hyp Amidite
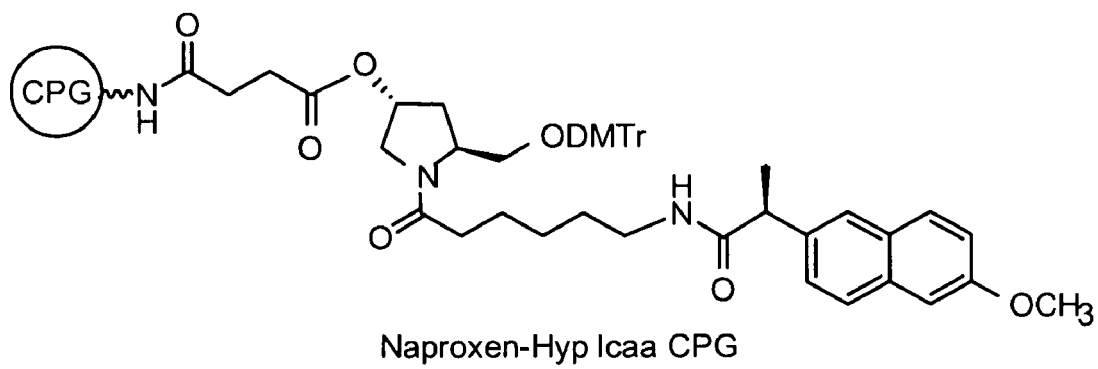
Naproxen-Hyp Icaa CPG
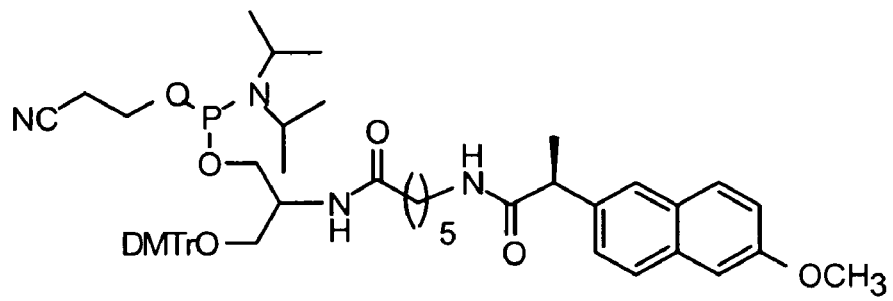
Naproxen-Serinol Amidite
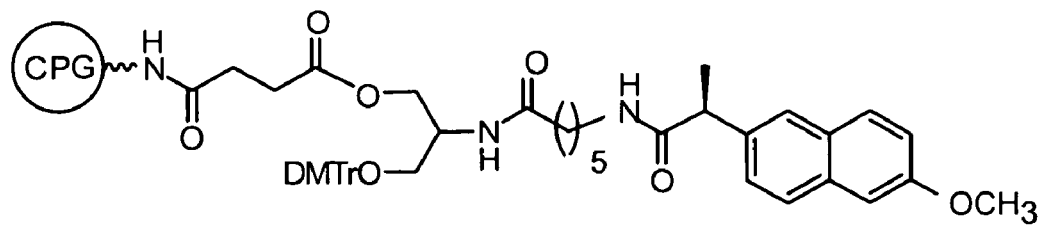
Naproxen-Serinol Icaa CPG
FIG. 42

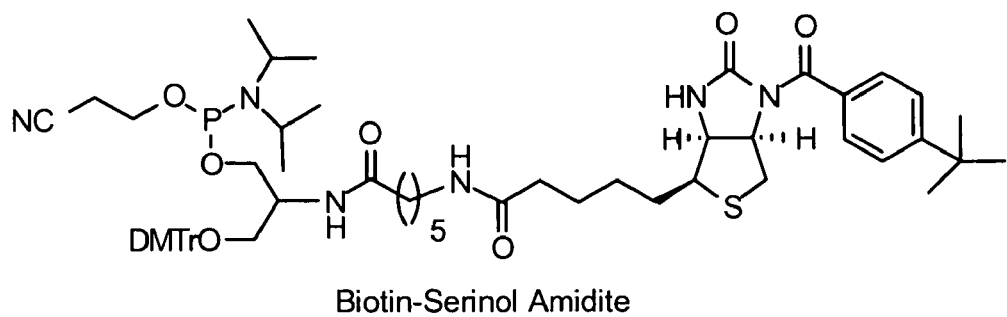
Biotin-Serinol Amidite
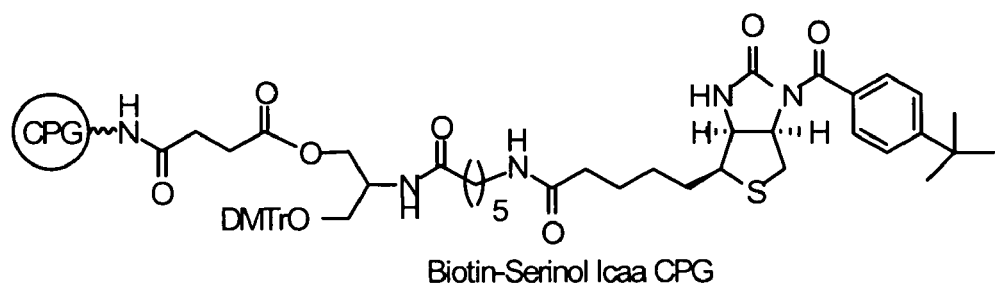
Biotin-Serinol Icaa CPG
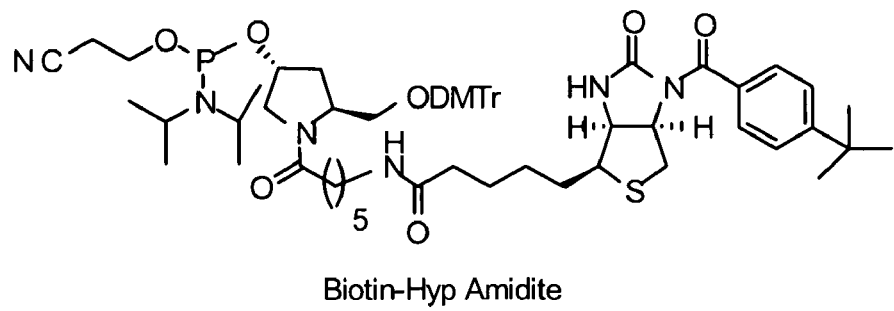
Biotin-Hyp Amidite
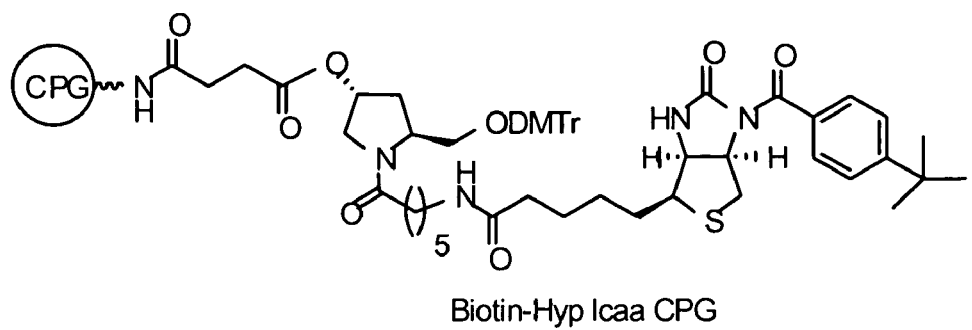
Biotin-Hyp Icaa CPG
FIG. 43

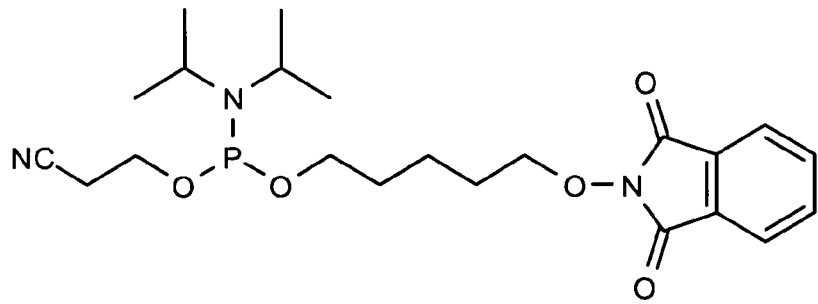
5' - Postsynthetic conjugation building blocks
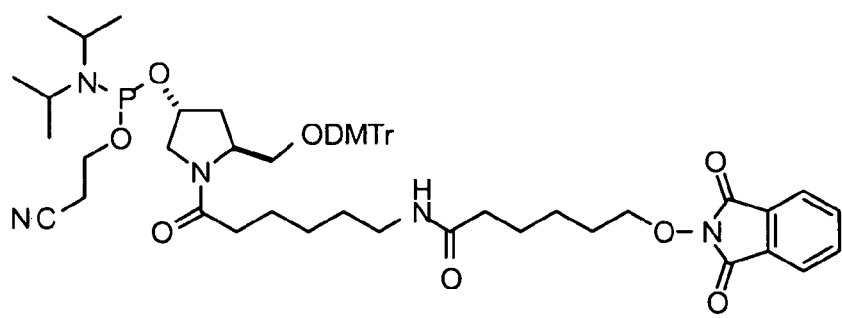
Postsynthetic conjugation building blocks for 5' conjugation
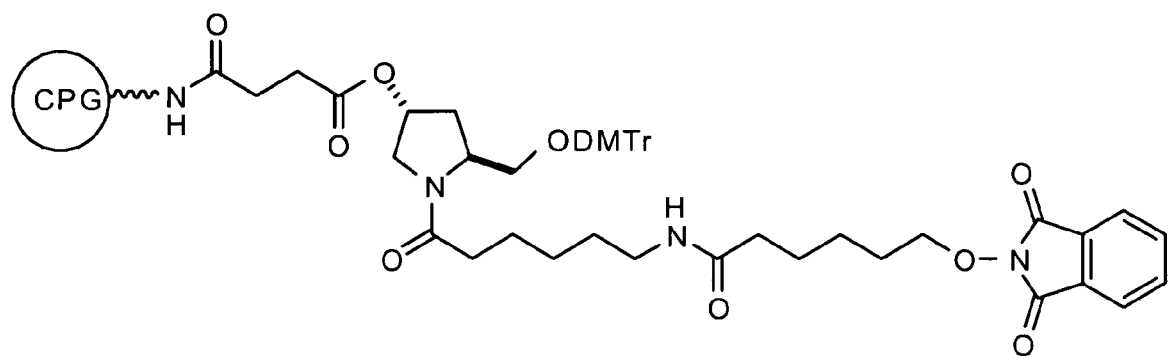
Postsynthetic conjugation building blocks for 3' conjugation
FIG. 44

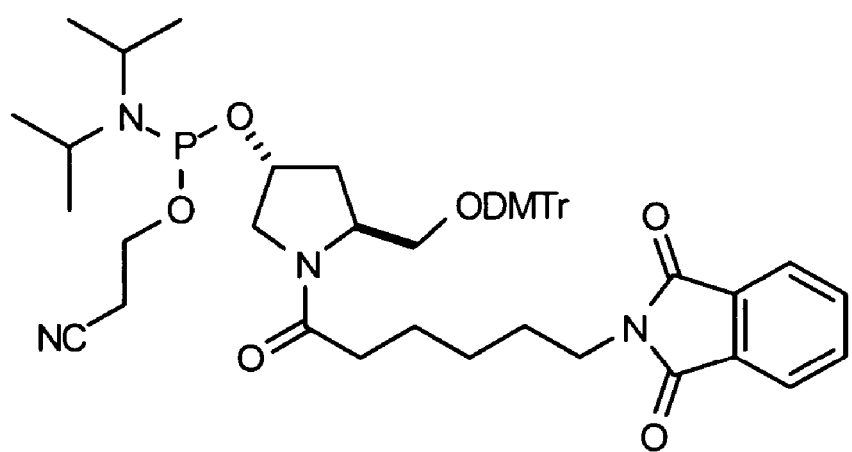
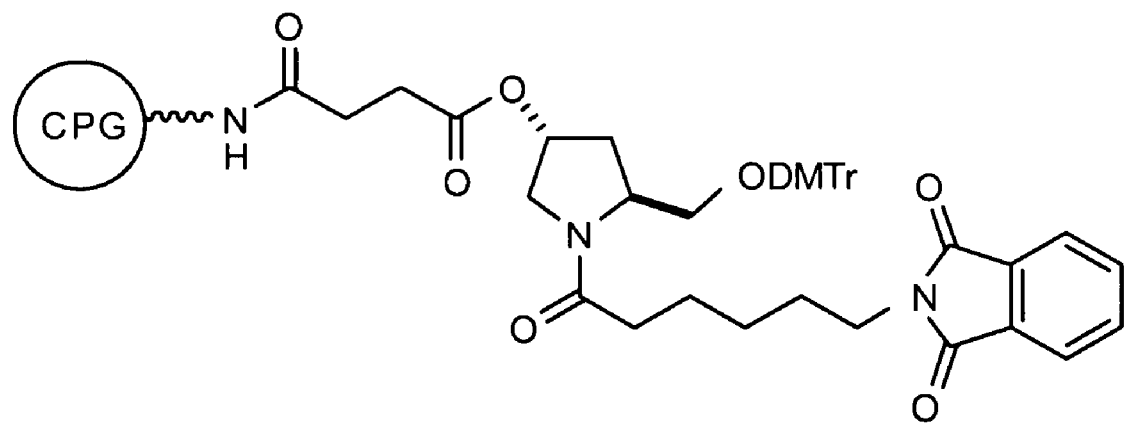
FIG. 45

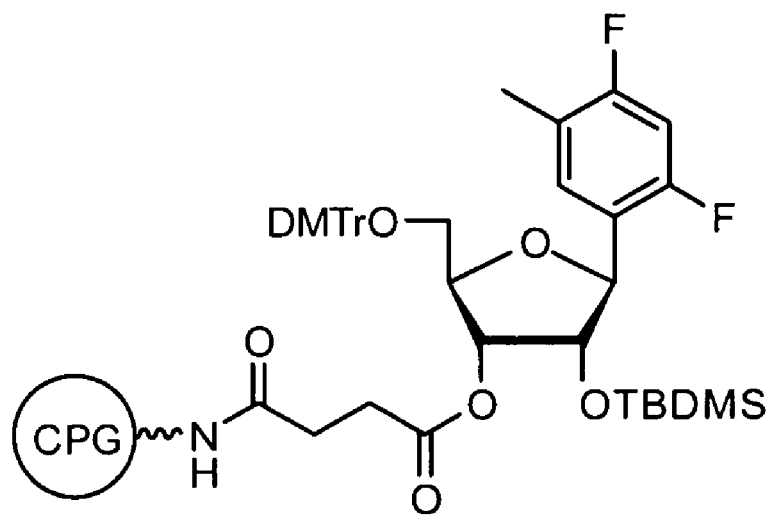
DFT Icaa CPG
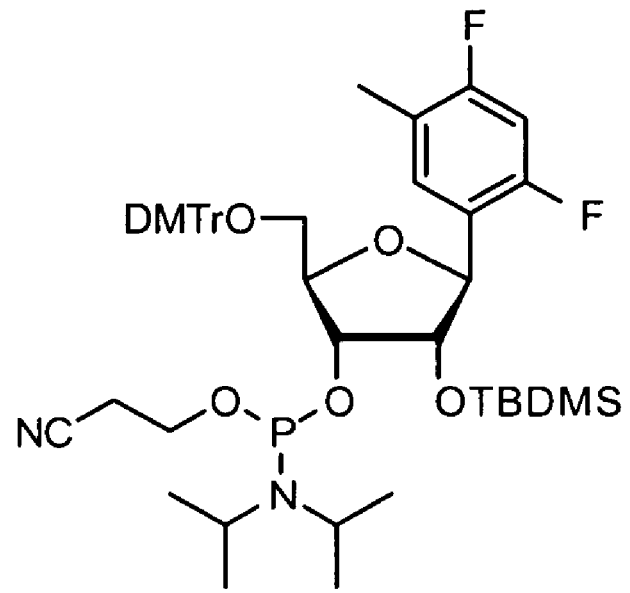
DFT Amidite
FIG. 46

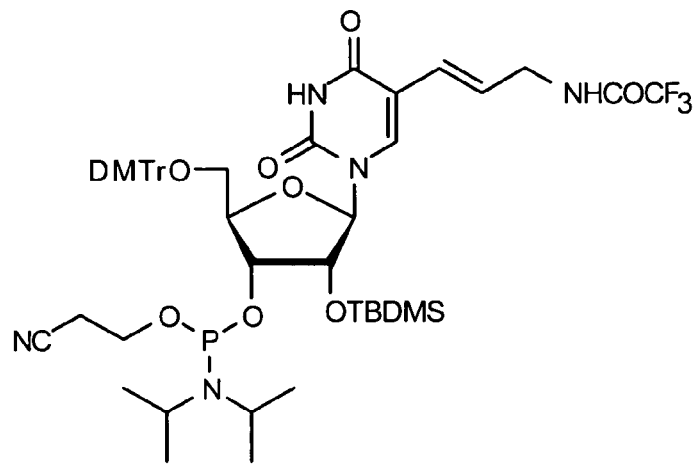
FIG. 49
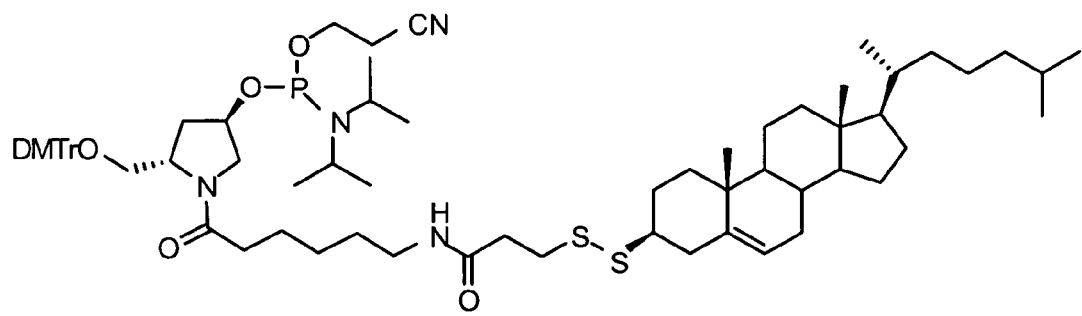
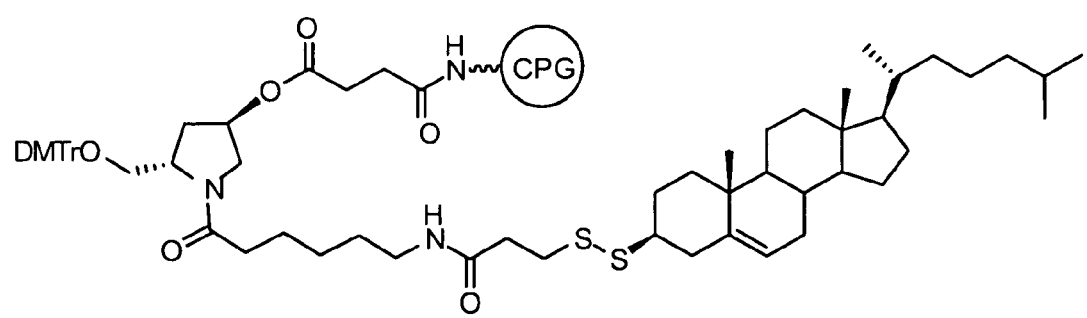
FIG. 50

IRNA AGENTS TARGETING VEGF

RELATED APPLICATIONS

This application is a continuation-in-part application of U.S. application Ser. No. 11/078,073, filed Mar. 11, 2005, which claims the benefit of U.S. Provisional Application No. 60/552,620, filed Mar. 12, 2004; U.S. Provisional Application No. 60/559,824, filed Apr. 5, 2004; and U.S. Provisional Application No. 60/647,191, filed Jan. 25, 2005. The contents of these applications are incorporated herein by reference in their entirety.

SEQUENCE LISTING

This application incorporates by reference the sequence listing saved as an ASCII text file and identified as "14174-129001.txt", containing 340 KB of data and created on May 30, 2006, filed in computer-readable format (CRF) and Official copy (Copy 1 and Copy 2), and each encoded on the CD-ROM and mailed with the present application.

FIELD OF THE INVENTION

The present invention is in the filed of iRNA agents that can inhibit expression of vascular endothelial growth factor (VEGF). The invention also relates to the use of siRNA targeting VEGF sequences to treat conditions or disorders related to unwanted expression of VEGF, e.g., age-related macular degeneration or diabetic retinopathy.

BACKGROUND

VEGF (also known as vascular permeability factor, VPF) is a multifunctional cytokine that stimulates angiogenesis, epithelial cell proliferation, and endothelial cell survival. VEGF can be produced by a wide variety of tissues, and its overexpression or aberrant expression can result in a variety of disorders, including retinal disorders such as age-related macular degeneration and diabetic retinopathy, cancer, asthma, and other angiogenic disorders.

Macular degeneration is a major cause of blindness in the United States and the frequency of this disorder increases with age. Macular degeneration refers to the group of diseases in which sight-sensing cells in the macular zone of the retina malfunction or loose function and which can result in debilitating loss of vital central or detail vision. Adult macular degeneration (AMD), which is the most common form of macular degeneration, occurs in two main forms. Ninety percent of people with AMD have the form described as "dry" macular degeneration. An area of the retina is affected, which leads to slow breakdown of cells in the macula, and a gradual loss of central vision. The other form of AMD is "wet" macular degeneration. Although only 10% of people with AMD have this type, it accounts for 90% of blindness from the disease. As dry AMD progresses, new blood vessels may begin to grow and cause "wet" AMD. These new blood vessels often leak blood and fluid under the macula. This causes rapid damage to the macula that can lead to loss of central vision in a short time. iRNA agents targeting VEGF can be useful for the treatment of wet and dry macular degeneration.

RNA interference or "RNAi" is a term initially coined by Fire and co-workers to describe the observation that double-stranded RNA (dsRNA) can block gene expression when it is introduced into worms (Fire et al., Nature 391:806-811, 1998). Short dsRNA directs gene-specific, post-transcriptional silencing in many organisms, including vertebrates, and has provided a new tool for studying gene function. RNAi has been suggested as a method of developing a new class of therapeutic agents. However, to date, these have remained mostly as suggestions with no demonstrate proof that RNAi can be used therapeutically.

The present invention advances the art by providing a detailed gene walk across the VEGF gene and a detailed structural analysis of modifications that can be employed to stabilize the molecule against degradation and increase cellular uptake and targeting.

SUMMARY OF THE INVENTION

The invention provides compounds, compositions and methods useful for modulating the expression of VEGF. The invention provides compounds, compositions and methods useful for modulating the expression of VEGF activity by RNA interference (RNAi) using small nucleic acid molecules, such as short interfering RNA (siRNA), double-stranded RNA (dsRNA), microRNA (miRNA) and short hairpin RNA (shRNA) molecules, which collectively fall under the general term of iRNA agents. The iRNA agents can be unmodified or chemically-modified nucleic acid molecules. The iRNA agents can be chemically synthesized or expressed from a vector or enzymatically synthesized. The invention provides various chemically-modified synthetic iRNA agents capable of modulating VEGF gene expression or activity in cells and in a mammal by RNAi. The use of a chemically-modified iRNA agent can improve one or more properties of an iRNA agent through increased resistance to degradation, increased specificity to target moieties, improved cellular uptake, and the like.

In one aspect, the invention provides an iRNA agent that down-regulates expression of a VEGF gene. The VEGF gene can include a VEGF encoding sequence and/or VEGF regulatory sequences such as may exist 5' or 3' of a VEGF open reading frame (ORF).

In one embodiment, the invention provides an isolated iRNA agent including a sense and antisense sequence, where the sense and antisense sequences can form an RNA duplex. The sense sequence can include a nucleotide sequence that is identical or substantially identical to a target sequence of about 19 to 23 nucleotides of a VEGF sequence. In one embodiment, the VEGF sequence that is targeted includes the sequence of any one of SEQ ID NOs:2-401 (see Table 1).

In one embodiment, the sense sequence of the iRNA agent includes a sequence identical or substantially identical to any of the VEGF target sequences, e.g., substantially identical to any of sense sequences provided in Table 1, SEQ ID NOs:2-401. In another embodiment, the antisense sequence of the iRNA agent can include a sequence complementary to or substantially complementary to, any of the target sequences, e.g., complementary to any of SEQ ID NOs:2-401. By "substantially identical" is meant that the mismatch between the nucleotide sequences is less than 50%, 40%, 30%, 20%, 10%, 5%, or 1%. Preferably, no more than 1, 2, 3, 4, or 5 nucleotides differ between the target sequence and sense sequence. Furthermore, sequences that are "complementary" to each other (e.g., sense and antisense sequences) can be fully complementary, or can have no more than 1, 2, 3, 4, or 5 nucleotides that lack full complementarity.

In one embodiment, the sense and antisense pairs of sequences of an iRNA agent includes any one of the agents provided in Table 2, or a sequence which differs in the sense strand from the recited sequence by no more than 1, 2, 3, 4, or 5 nucleotides, or in the antisense strand by no more than 1, 2, 3, 4, or 5 nucleotides, or in both strands by no more than 1, 2, 3, 4, or 5 nucleotides.

In one preferred embodiment, the sense sequence of an iRNA agent includes a sequence that is selected from the group consisting of SEQ ID NO:456, SEQ ID NO:550, SEQ ID NO:608, and SEQ ID NO:634, or a sequence that differs from the recited sequence by no more than 1, 2, 3, 4, or 5 nucleotides.

In another embodiment, the antisense sequence of the iRNA agent includes a sequence fully complementary or substantially complementary to any of the VEGF target sequences, e.g., complementary or substantially complementary to any of SEQ ID NOs:2-401.

In another embodiment, the antisense sequence of an iRNA agent includes a sequence selected from the group consisting any of the antisense sequences provided in Table 2, or a sequence which differs from the recited sequence by no more than 1, 2, 3, 4, or 5 nucleotides. In a preferred embodiment, this antisense sequence is fully complementary to a sense sequence or has no more than 1, 2, 3, 4, or 5 nucleotide mismatches with the sense sequence.

In a preferred embodiment, the antisense sequence of an iRNA agent includes a sequence selected from the group consisting of SEQ ID NO:457, SEQ ID NO:551, SEQ ID NO:609, and SEQ ID NO:635, or a sequence that differs from the recited sequence by no more than 1, 2, 3, 4, or 5 nucleotides.

In another embodiment, the iRNA agent is chemically modified. For example, the iRNA agent can include a non-nucleotide moiety. A chemical modification or other non-nucleotide moiety can stabilize the sense and antisense sequences against nucleolytic degradation. Additionally, conjugates can be used to increase uptake and target uptake of the iRNA agent to particular cell types. Preferred modifications include those specifically provided in the Examples, Tables 6-19.

In another embodiment, the iRNA agent includes a 3'-overhang that ranges from 1 to about 6 nucleotides. As used herein, a "3' overhang" refers to at least one unpaired nucleotide extending from the 3' end of an iRNA sequence. The 3' overhang can include ribonucleotides or deoxyribonucleotides or modified ribonucleotides or modified deoxyribonucleotides. The 3' overhang is preferably from 1 to about 5 nucleotides in length, more preferably from 1 to about 4 nucleotides in length and most preferably from about 2 to about 4 nucleotides in length. The 3' overhang can occur on the sense or antisense sequence, or on both sequences of an iRNA agent.

In one preferred embodiment, the iRNA agent of the invention includes an antisense sequence having 23 nucleotides complementary to the target VEGF sequence and a sense sequence having at least 21 nucleotides. Each sequence can include at least 21 nucleotides that are complementary to each other, and at least the antisense sequence can have a 3' overhang of two nucleotides.

In one embodiment, both the sense and antisense sequences of the iRNA agent include a 3' overhang, the length of which can be the same or different for each sequence. In one embodiment, the 3' overhang on each sequence ranges from 1 to about 6 (e.g., from 1 to about 3) nucleotides in length. In a preferred embodiment, the 3' overhang is on both sequences of the iRNA agent and is two nucleotides in length. In another preferred embodiment, the 3' overhang is on both sequences of the iRNA agent and the 3' overhangs include two thymidylic acid residues ("TT").

In one embodiment, an iRNA agent includes an antisense sequence having about 19 to 25 (e.g., about 19, 20, 21, 22, 23, 24, or 25) nucleotides with complementarity to an RNA sequence encoding a VEGF protein. The iRNA agent can further include a sense sequence having about 19 to 25 (e.g., about 19, 20, 21, 22, 23, 24, or 25) nucleotides, and the antisense and sense sequences can have distinct nucleotide sequences with at least about 19, 20, or 21 complementary nucleotides.

In one embodiment, an iRNA agent of the invention includes an antisense region having about 19 to about 25 (e.g., about 19 to about 23) nucleotides with complementarity to an RNA sequence encoding VEGF, and a sense region having about 19 to 25 (e.g., about 19 to about 23) nucleotides. The sense and antisense regions can be included in a linear molecule with at least about 19 complementary nucleotides. The sense sequence can include a nucleotide sequence that is substantially identical to a nucleotide sequence of VEGF.

In one embodiment, the iRNA agent includes an antisense sequence of about 21 nucleotides complementary to the VEGF target sequence and a sense sequence of about 21 nucleotides complementary to the antisense sequence. The iRNA agent can include a non-nucleotide moiety. In one embodiment, the sense or antisense sequence of the iRNA agent can include a 2'-O-methyl (2'-OMe) pyrimidine nucleotide, 2'-deoxy nucleotide (e.g., deoxy-cytodine), 2'-deoxy-2'-fluoro (2'-F) pyrimidine nucleotide, 2'-O-methoxyethyl (2'-O-MOE), 2'-O-aminopropyl (2'-O-AP), 2'-O—N-methylacetamido (2'-O-NMA), 2'-O-dimethylaminoethlyoxyethyl (2'-DMAEOE), 2'-O-dimethylaminoethyl (2'-O-DMAOE), 2'-O-dimethylaminopropyl (2'-O-AP), 2'-hydroxy nucleotide, or a 2'-ara-fluoro nucleotide, or a locked nucleic acid (LNA), extended nucleic acid (ENA), hexose nucleic acid (HNA), cyclohexene nucleic acid (CeNA), ribo-difluorotoluoyl, 5-allyamino-pyrimidines, or 5-Me-2'-modified pyrimidines. A 2' modification is preferably a 2'-OMe modification, and more preferably, a 2'-fluoro modification. In a preferred embodiment, one or more 2' modified nucleotides are on the sense strand of the iRNA agent.

In one embodiment, an iRNA agent includes a nucleobase modification, such as a cationic modification, such as a 3'-abasic cationic modification. The cationic modification can be, e.g., an alkylamino-dT (e.g., a C6 amino-dT), an allylamino conjugate, a pyrrolidine conjugate, a pthalamido a hydroxyprolinol conjugate or an aminooxy conjugate, on one or more of the terminal nucleotides of the iRNA agent. An alkylamino-dT conjugate is preferably attached to the 3' end of the sense or antisense strand of an iRNA agent. A pyrrolidine linker is preferably attached to the 3' or 5' end of the sense strand, or the 3' end of the antisense strand. An allyl amine uridine is preferably on the 3' or 5' end of the sense strand, and not on the 5' end of the antisense strand. An aminooxy conjugate can be attached to a hydroxyl prolinol and at the 3' or 5' end of either the sense or antisense strands.

In another embodiment, an iRNA agent that targets VEGF includes a conjugate, e.g., to facilitate entry into a cell or to inhibit exo- or endonucleolytic cleavage. The conjugate can be, for example, a lipophile, a terpene, a protein binding agent, a vitamin, a carbohydrate, a retinoid or a peptide. For example, the conjugate can be naproxen, nitroindole (or another conjugate that contributes to stacking interactions), folate, ibuprofen, retinol or a C5 pyrimidine linker. In other embodiments, the conjugates are glyceride lipid conjugates (e.g. a dialkyl glyceride derivatives), vitamin E conjugates, or thio-cholesterols. Preferably, conjugates are on the 3' end of the antisense strand, or on the 5' or 3' end of the sense strand, and preferably the conjugates are not on the 3' end of the antisense strand and on the 3' end of the sense strand.

In one embodiment, the conjugate is naproxen, and the conjugate is preferably on the 5' or 3' end of the sense or antisense strands. In one embodiment, the conjugate is cholesterol or thiocholesterol, and the conjugate is preferably on the 5' or 3' end of the sense strand and preferably not present on the antisense strand. In some embodiments, the cholesterol is conjugated to the iRNA agent by a pyrrolidine linker, or serinol linker, or hydroxyprolinol linker. In another embodiment, the conjugate is cholanic acid, and the cholanic acid is attached to the 5' or 3' end of the sense strand, or the 3' end of the antisense strand. In one embodiment, the cholanic acid is attached to the 3' end of the sense strand and the 3' end of the antisense strand. In another embodiment, the conjugate is retinol acid, and the retinol acid is attached to the 5' or 3' end of the sense strand, or the 3' end of the antisense strand. In one embodiment, the retinol acid is attached to the 3' end of the sense strand and the 3' end of the antisense strand.

In one aspect, an iRNA agent of the invention has RNAi activity that modulates expression of RNA encoded by a VEGF gene. VEGF genes can share some degree of sequence identity with each other, and thus, iRNA agents can target a class of VEGF genes, or alternatively, specific VEGF genes, by targeting sequences that are either shared amongst different VEGF targets or that are unique for a specific VEGF target. Therefore, in one embodiment, an iRNA agent can target a conserved region of a VEGF nucleotide sequence (e.g., RNA sequence). The conserved region can have sequence identity with several different VEGF-related sequences (e.g., different VEGF isoforms, splice variants, mutant genes, etc.). Thus, one iRNA agent can target several different VEGF-related sequences.

In one embodiment, an iRNA agent is chemically modified. In another embodiment the iRNA agent includes a duplex molecule wherein one or more sequences of the duplex molecule is chemically modified. Non-limiting examples of such chemical modifications include phosphorothioate internucleotide linkages, 2'-deoxyribonucleotides, 2'-O-methyl ribonucleotides, 2'-deoxy-2'-fluoro ribonucleotides, "universal base" nucleotides, "acyclic" nucleotides, 5'-C-methyl nucleotides, and terminal glyceryl and/or inverted deoxy abasic residue incorporation. These chemical modifications, when used in iRNA agents, can help to preserve RNAi activity of the agents in cells and can increase the serum stability of the iRNA agents.

In one embodiment, an iRNA agent includes one or more chemical modifications and the sense and antisense sequences of the double-stranded RNA is about 21 nucleotides long.

In a preferred embodiment, the first and preferably the first two internucleotide linkages at the 5' end of the antisense and/or sense sequences are modified, preferably by a phosphorothioate. In a preferred embodiment, the first, and preferably the first two, three, or four internucleotide linkages at the 3' end of a sense and/or antisense sequence are modified, preferably by a phosphorothioate. More preferably, the 5' end of both the sense and antisense sequences, and the 3' end of both the sense and antisense sequences are modified as described.

In another aspect, an iRNA agent that mediates the down-regulation of VEGF expression includes one or more chemical modifications that modulate the binding affinity between the sense and the antisense sequences of the iRNA construct.

In one embodiment, the invention features an iRNA agent that includes one or more chemical modifications that can modulate the cellular uptake of the iRNA agent.

In another embodiment, the invention features an iRNA agent that includes one or more chemical modifications that improve the pharmacokinetics of the iRNA agent. Such chemical modifications include but are not limited to conjugates, such as ligands for cellular receptors, e.g., peptides derived from naturally occurring protein ligands; protein localization sequences; antibodies; nucleic acid aptamers; vitamins and other co-factors, such as folate, retinoids and N-acetylgalactosamine; polymers, such as polyethyleneglycol (PEG, e.g. PEG 5 and PEG20); phospholipids; polyamines, such as spermine or spermidine; and others.

In one embodiment, the iRNA agent includes a duplex molecule selected from the group consisting of AL-DP-4003, AL-DP-4116, AL-DP-4015, AL-DP-4120, AL-DP-4002, AL-DP-4115, AL-DP-4014, AL-DP-4119, AL-DP-4094, AL-DP-4118, AL-DP-4107, AL-DP-4122, AL-DP-4004, AL-DP-4117, AL-DP-4016, AL-DP-4121, AL-DP-4127, AL-DP-4128, AL-DP-4129, and AL-DP-4055 (see Tables 2 and 3).

In one preferred embodiment, the iRNA agent includes a duplex described as AL-DP-4094, which includes the antisense sequence 5'AAGCUCAUCUCUCCUAUGUGCUG 3' (SEQ ID NO:609) and the sense sequence 5' GCACAUAGGAGAGAUGAGCUU 3' (SEQ ID NO:608).

In another preferred embodiment, the iRNA agent includes a duplex described as AL-DP-4004, which includes the antisense sequence 5'CUUUCUUUGGUCUGCAUUCACAU 3' (SEQ ID NO:635) and the sense sequence 5' GUGAAUGCAGACCAAAGAAAG 3' (SEQ ID NO:634).

In another preferred embodiment, the iRNA agent includes a duplex described as AL-DP-4015, which includes the antisense sequence 5' GUACUCCUGGAAGAUGUCCTT 3' (SEQ ID NO:551) and the sense sequence 5' GGACAUCUUCCAGGAGUACTT 3' (SEQ ID NO:550).

In another preferred embodiment, the iRNA agent includes a duplex described as AL-DP-4055, which includes the antisense sequence 5' UGCAGCCUGGGACCACUUGTT 3' (SEQ ID NO:457) and the sense sequence 5' CAAGUGGUCCCAGGCUGCATT 3' (SEQ ID NO:456).

In one embodiment, the antisense sequence of an iRNA agent described herein does not hybridize to an off-target sequence. For example, the antisense sequence can have less than 5, 4, 3, 2, or 1 nucleotides complementary to an off-target sequence. By "off-target" is meant a sequence other than a VEGF nucleotide sequence.

In another embodiment, the sense strand is modified to inhibit off-target silencing. The sense strand can include a cholesterol moeity, such as cholesterol attached to the sense strand by a pyrrolidine linker.

In another embodiment, the antisense sequence of an iRNA agent described herein can hybridize to a VEGF sequence in a human and a VEGF sequence in a non-human mammal, e.g., a mouse, rat, or monkey.

In another aspect, the invention provides a method of delivering an iRNA agent, e.g., an iRNA agent described herein, to the eye of a subject, e.g., a mammalian subject, such as a mouse, a rat, a monkey or a human.

In one embodiment, the iRNA agent can be delivered to a cell or cells in a choroid region of the eye. In one preferred embodiment, the iRNA agent down-regulates expression of the VEGF gene at a target site within the eye. An iRNA agent delivered to the eye, e.g., choroid cells of the eye, can be an unmodified iRNA agent.

In one embodiment, the iRNA agent can be stabilized with phosphorothioate linkages. In another embodiment, the 3' end of the sense or antisense sequences, or both, of the iRNA agent can be modified with a cationic group, such as a 3'-abasic cationic modification. The cationic modification can be, e.g., an alkylamino-dT (e.g., a C6 amino-dT), an allylamine, a pyrrolidine, a pthalamido, a hydroxyprolinol, a polyamine, a cationic peptide, or a cationic amino acid on one or more of the terminal nucleotides of the iRNA agent. The modification can be an external or terminal cationic residue. In preferred embodiments, a pyrrolidine cap is attached to the 3' or 5' end of the sense strand, or the 3' end of the antisense strand.

In one embodiment, the sense or antisense sequence, or both, of the iRNA agent can be modified with a sugar, e.g., a glycoconjugate or alkylglycoside component, e.g., glucose, mannose, 2-deoxy-glucose, or an analog thereof. In another embodiment, the iRNA agent can be conjugated to an enzyme substrate, e.g., a substrate for which the relative enzyme is present in a higher amount, as compared to the enzyme level in other tissues of the body, e.g., in tissues other than the eye.

In one embodiment, at least about 30%, 40%, 50%, 60%, 70%, 80%, 90% or more of the iRNA agent administered to the subject reaches the eye. In a preferred embodiment, between about 30-90%, 40-80% or 50-70% of the iRNA agent administered to the subject reaches the eye.

In another aspect, the invention features a composition, e.g., a pharmaceutical composition that includes an iRNA agent of the present invention in a pharmaceutically acceptable carrier or diluent. The iRNA agent can be any agent described herein. In one embodiment, the iRNA agent is chemically modified, such as with any chemical modification described herein. Preferred modified iRNA agents includes those provided in Tables 2-19.

In another aspect, the invention features a method for treating or preventing a disease or condition in a subject. The method can include administering to the subject a composition of the invention under conditions suitable for the treatment or prevention of the disease or condition in the subject, alone or in conjunction with one or more other therapeutic compounds.

In one embodiment, the iRNA agent is administered at or near the site of unwanted VEGF expression, e.g., by a catheter or other placement device (e.g., a retinal pellet or an implant including a porous, non-porous, or gelatinous material). In one embodiment the iRNA agent is administered via an intraocular implant, which can be inserted, for example, into an anterior or posterior chamber of the eye; or into the sclera, transchoroidal space, or an avascularized region exterior to the vitreous. In another embodiment, the implant is positioned over an avascular region, such as on the sclera, so as to allow for transcleral diffusion of the drug to the desired site of treatment, e.g., to the intraocular space and macula of the eye. Furthermore, the site of transcleral diffusion is preferably in proximity to the macula.

In another embodiment, an iRNA agent is administered to the eye by injection, e.g., by intraocular, retinal, or subretinal injection.

In another embodiment, an iRNA agent is administered topically to the eye, such as by a patch or liquid eye drops, or by iontophoresis. Ointments or droppable liquids can be delivered by ocular delivery systems known in the art such as applicators or eye droppers.

In one embodiment, an iRNA is delivered at or near a site of neovascularization.

In one embodiment, an iRNA agent is administered repeatedly. Administration of an iRNA agent can be carried out over a range of time periods. It can be administered hourly, daily, once every few days, weekly, or monthly. The timing of administration can vary from patient to patient, depending upon such factors as the severity of a patient's symptoms. For example, an effective dose of an iRNA agent can be administered to a patient once a month for an indefinite period of time, or until the patient no longer requires therapy. In addition, sustained release compositions containing an iRNA agent can be used to maintain a relatively constant dosage in the area of the target VEGF nucleotide sequences.

In another embodiment, an iRNA agent is delivered to the eye at a dosage on the order of about 0.00001 mg to about 3 mg per eye, or preferably about 0.0001-0.001 mg per eye, about 0.03-3.0 mg per eye, about 0.1-3.0 mg per eye or about 0.3-3.0 mg per eye.

In another embodiment, an iRNA agent is administered prophylactically such as to prevent or slow the onset of a disorder or condition that affects the eye. For example, an iRNA can be administered to a patient who is susceptible to or otherwise at risk for a neovascular disorder.

In one embodiment one eye of a human is treated with an iRNA agent described herein, and in another embodiment, both eyes of a human are treated.

In another aspect, a method of inhibiting VEGF expression is provided. One such method includes administering an effective amount of an iRNA agent of the present invention.

In another aspect, a method of treating adult onset macular degeneration is provided. The method includes administering a therapeutically effective amount of an iRNA agent of the present invention.

In one embodiment, a human has been diagnosed with dry adult macular degeneration (AMD), and in another embodiment the human has been diagnosed with wet AMD.

In one embodiment, a human treated with an iRNA agent described herein is over the age of 50, e.g., between the ages of 75 and 80, and the human has been diagnosed with adult onset macular degeneration. In another embodiment, a human treated with an iRNA agent described herein is between the ages of 30-50, and the human has been diagnosed with late onset macular degeneration. In another embodiment, a human treated with an iRNA agent described herein is between the ages of 5-20, and the human has been diagnosed with middle onset macular degeneration. In another embodiment, a human treated with an iRNA agent described herein is 7 years old or younger, and the human has been diagnosed with early onset macular degeneration.

In one aspect, methods of treating any disease or disorder characterized by unwanted VEGF expression are provided. Particularly preferred embodiments include the treatment of disorders of the eye or retina, which are characterized by unwanted VEGF expression. The disease or disorder can be a diabetic retinopathy, neovascular glaucoma, a tumor or metastic cancer (e.g., colon or breast cancer), a pulmonary disease (e.g., asthma or bronchitis), rheumatoid arthritis, or psoriases. Other angiogenic disorders can be treated by the methods featured in the invention.

In another aspect, the invention features a kit containing an iRNA agent of the invention. The iRNA agent of the kit can be chemically modified and can be useful for modulating the expression of a VEGF target gene in a cell, tissue or organism. In one embodiment, the kit contains more than one iRNA agent of the invention.

Unless otherwise defined, all technical and scientific terms used herein have the same meaning as commonly understood by one of ordinary skill in the art to which this invention pertains. Although methods and materials similar or equivalent to those described herein can be used in the practice or testing of the present invention, useful methods and materials are described below. The materials, methods, and examples are illustrative only and not intended to be limiting. Other features and advantages of the invention will be apparent from the accompanying drawings and description, and from the claims. The contents of all references, pending patent applications and published patents, cited throughout this application are hereby expressly incorporated by reference. In case of conflict, the present specification, including definitions, will control.

BRIEF DESCRIPTION OF THE DRAWINGS

FIG. 1 is the nucleotide sequence of the mRNA of the 121 amino acid form of vascular endothelial growth factor, VEGF121. The first nucleotide of the initiator codon is nucleotide 1. The signal peptide is from nucleotide 1 through 78.

FIG. 6A is a graphical representation of the activities of single-overhang and double overhang siRNAs targeting ORF 319 (SEQ ID NO:320) (AL-DP-4002 and AL-DP-4014, respectively) and ORF 343 (SEQ ID NO:344) (AL-DP-4094 and AL-DP-4107, respectively) in cells under normal oxygen (normoxia, 20% oxygen).

FIGS. 9A-9E are graphical representations of the activities of siRNAs having the sequence of AL-DP-4094 but differing in the inclusion of nucleotide modifications (see Table 4). FIG. 9A sense strands disclosed as SEQ ID NO: 652 and antisense strands disclosed as SEQ ID NOS 653-658, respectively in order of appearance. FIG. 9B sense strands disclosed as SEQ ID NO: 659 and antisense strands disclosed as SEQ ID NOS 653-658, respectively in order of appearance. FIG. 9C sense strands disclosed as SEQ ID NO: 660 and antisense strands disclosed as SEQ ID NOS 653-658, respectively in order of appearance. FIG. 9D sense strands disclosed as SEQ ID NO: 661 and antisense strands disclosed as SEQ ID NOS 653-658, respectively in order of appearance. FIG. 9E sense strands disclosed as SEQ ID NOS 662-665, 652, 652 and 652 and antisense strands disclosed as SEQ ID NO: 653, 653, 653, 653 and 666-668, respectively in order of appearance. The control siRNA "Acuity" is identical to the Cand5 control of FIG. 8A and the hVEGF control of FIG. 7. The "Filleur" control siRNA is the equivalent of the hrmVEGF control siRNA of FIG. 7.

FIG. 12 is a summary of AL-DP-4094 fragment mapping as determined by LC/MS. The analysis was performed following incubation of the siRNA in human serum (SEQ ID NOS 608-609, 1080-1082, 1082-1083, 608, 611, 611 and 1084, respectively, in order of appearance)

FIG. 39 5'-O-DMTr-2'-deoxy-2'-fluoro A, C, G and U CPG supports for oligonucleotide synthesis. These supports were used for syntheses of selected sequences listed Tables 6 and 7.

FIG. 41 $^{5Me}C$ and $^{5Me}U$ RNA building blocks for oligonucleotide synthesis. These building blocks were used for syntheses of selected sequences listed in Table 8.

FIG. 42. Naproxen—trans-4-hydroxy-L-prolinol and naproxen-serinol building blocks for conjugation to oligonucleotides. These building blocks were used for syntheses of selected sequences listed in Table 9.

FIG. 43 Biotin—trans-4-hydroxy-L-prolinol and biotin-serinol building blocks for conjugation to oligonucleotides. These building blocks were used for syntheses of selected sequences listed in Table 10.

FIG. 44 Building blocks for post-synthetic conjugation—Oxime approach. These building blocks were/are used for syntheses of selected sequences listed in Table 11.

FIG. 45 Building blocks for post-synthetic conjugation—Active ester approach. These building blocks were used for syntheses of selected sequences listed in Table 12.

FIG. 46 DFT amidite and CPG for oligonucleotide synthesis. These building blocks were used for syntheses of selected sequences listed in Table 13.

FIG. 47 2'-Deoxy-2'-araf amidite for oligonucleotide synthesis. These building blocks were used for syntheses of selected sequences listed in Table 14.

FIG. 49 C5-aminoallyl U amidite. These building blocks were used for syntheses of selected sequences listed in Table 16.

FIG. 50 Thiocholesterol conjugate building blocks.

BRIEF DESCRIPTION OF THE TABLES

Figure 2:
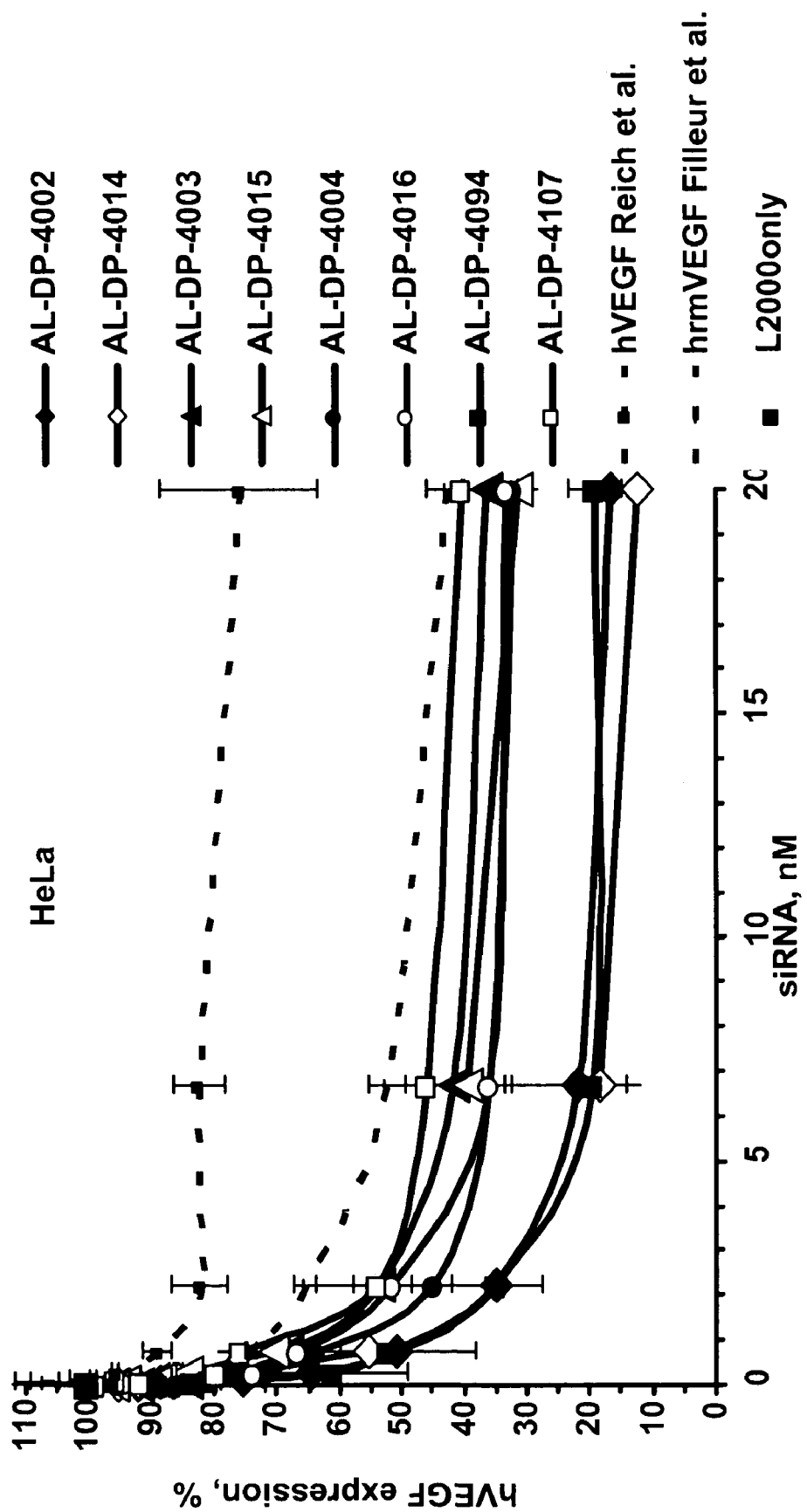
FIG. 2 is a graphical representation of a comparative analysis of the activities of single- and double-overhang siRNAs in in vitro assays in HeLa cells. Solid lines with filled symbols represent the single-overhang siRNA, solid lines with open symbols represent the double-overhang siRNAs; dashed lines represent the control siRNAs. The control siRNA hVEGF is described in Reich et al. (*Mol. Vis.* 9:210, 2003); the control siRNA hrmVEGF is described in Filleur et al. (*Cancer Res.* 63:3919, 2003). "L2000" refers to Lipofectamine 2000 reagent. hVEGF expression (y-axis) refers to endogenous VEGF expression.

Table 1 provides the sequences in the VEGF gene that are targeted by the agents of the present invention. These sequence can also be the sense strand of some of the iRNA agents of the present invention.

Table 2 provides 123 iRNA duplexes that target the VEGF gene, the target sequence in the VEGF gene and activity data that is described in the Examples.

Table 3 provides iRNA duplexes that are modified to contain phosphorothioate stabilizations and activity data that is described in the Examples.

Table 4 provides iRNA duplexes based on the AL-DP-4094 duplex that are modified for stabilization and activity data that is described in the Examples.

Table 5 provides iRNA duplexes activity data in HeLa cells for several iRNA agents of the present invention.

Table 6 provides iRNA agents with activity data in HeLa cells for agents containing one or more phosphorothioate, 2'-O-methyl and 2'-fluoro modifications.

Table 7 provides iRNA agents with activity data in HeLa cells for agents containing alternating 2'-O-methyl and 2'-fluoro modifications.

Table 8 A and B provides iRNA agents with activity data in HeLa cells for agents containing cholesterol or cholanic acid conjugates.

Table 9 provides iRNA agents with activity data in HeLa cells for agents containing naproxen conjugates.

Table 10 provides iRNA agents with activity data in HeLa cells for agents containing biotin conjugates.

Table 11 provides iRNA agents containing aldehydes, retinal and other retinoid conjugates.

Table 12 provides iRNA agents containing polyethylene glycol conjugates.

Table 13 provides iRNA agents with activity data in HeLa cells for agents containing ribo-difluorotoluoyl modifications.

Table 14 provides iRNA agents with activity data in HeLa cells for agents containing 2'-arafluoro-2'-deoxy-nucleoside modifications.

Table 15 provides iRNA agents containing methylphosphonate modifications.

Table 16 provides iRNA agents containing C-5 allyamino modifications.

Table 17 provides iRNA agents containing a variety and combinations of the modifications as noted in the Table.

Table 18 provides physical characterization of iRNA agents containing a variety and combinations of the modifications as noted in the Table.

DETAILED DESCRIPTION

Double-stranded (dsRNA) directs the sequence-specific silencing of mRNA through a process known as RNA interference (RNAi). The process occurs in a wide variety of organisms, including mammals and other vertebrates.

It has been demonstrated that 21-23 nt fragments of dsRNA are sequence-specific mediators of RNA silencing, e.g., by causing RNA degradation. While not wishing to be bound by theory, it may be that a molecular signal, which may be merely the specific length of the fragments, present in these 21-23 nt fragments recruits cellular factors that mediate RNAi. Described herein are methods for preparing and administering these 21-23 nt fragments, and other iRNAs agents, and their use for specifically inactivating gene function. The use of iRNA agents (or recombinantly produced or chemically synthesized oligonucleotides of the same or similar nature) enables the targeting of specific mRNAs for silencing in mammalian cells. In addition, longer dsRNA agent fragments can also be used, e.g., as described below.

Although, in mammalian cells, long dsRNAs can induce the interferon response, which is frequently deleterious, siRNAs do not trigger the interferon response, at least not to an extent that is deleterious to the cell and host. In particular, the length of the sense and antisense sequences in an iRNA agent can be less than 31, 30, 28, 25, or 23 nt, e.g., sufficiently short to avoid inducing a deleterious interferon response. Thus, the administration of a composition of iRNA agents (e.g., formulated as described herein) to a mammalian cell can be used to silence expression of a target gene while circumventing the interferon response. Further, use of a discrete species of iRNA agent can be used to selectively target one allele of a target gene, e.g., in a subject heterozygous for the allele.

The target-complementary sequence (the antisense sequence) of an iRNA agent, such as an iRNA duplex, can have a 5' phosphate and ATP may be utilized to maintain the 5'-phosphate moiety on the siRNA (Nykanen et al., Cell 107: 309, 2001); however, iRNA agents lacking a 5'-phosphate have been shown to be active when introduced exogenously, suggesting that 5'-phosphorylation of siRNA constructs may occur in vivo.

Vascular endothelial growth factor (VEGF) VEGF, also known as vascular permeability factor, is an angiogenic growth factor. VEGF is a homodimeric 45 kDa glycoprotein that exists in at least three different isoforms. VEGF isoforms are expressed in endothelial cells. The VEGF gene contains 8 exons that express a 189-amino acid protein isoform. A 165-amino acid isoform lacks the residues encoded by exon 6, whereas a 121-amino acid isoform lacks the residues encoded by exons 6 and 7. VEGF145 is an isoform predicted to contain 145 amino acids and to lack exon 7.

VEGF can act on endothelial cells by binding to an endothelial tyrosine kinase receptor, such as Flt-1 (VEGFR-1) or KDR/flk-1 (VEGFR-2). VEGFR-2 is expressed in endothelial cells and is involved in endothelial cell differentiation and vasculogenesis. A third receptor, VEGFR-3 has been implicated in lymphogenesis.

The various isoforms have different biologic activities and clinical implications. For example, VEGF145 induces angiogenesis and like VEGF189 (but unlike VEGF165) VEGF145 binds efficiently to the extracellular matrix by a mechanism that is not dependent on extracellular matrix-associated heparin sulfates. The mRNA corresponding to the coding sequence of human VEGF121 (Genbank Accession Number AF214570, SEQ ID NO:1) is shown in FIG. 1. VEGF displays activity as an endothelial cell mitogen and chemoattractant in vitro and induces vascular permeability and angiogenesis in vivo. VEGF is secreted by a wide variety of cancer cell types and promotes the growth of tumors by inducing the development of tumor-associated vasculature. Inhibition of VEGF function has been shown to limit both the growth of primary experimental tumors as well as the incidence of metastases in immunocompromised mice. VEGF is also expressed at abnormally high levels in inflammatory diseases such as rheumatoid arthritis and psoriasis, and is involved in the inflammation, airway and vascular remodeling that occurs during asthmatic episodes. Elevated VEGF expression is also correlated with several forms of ocular neovascularization that often lead to severe vision loss, including diabetic retinopathy, retinopathy of prematurity, and macular degeneration.

iRNA Agents An "RNA agent," as used herein, is an unmodified RNA, modified RNA, or nucleoside surrogate. Preferred examples include those which have greater resistance to nuclease degradation than do unmodified RNAs. Preferred examples include those which have a 2' sugar modification, a modification in a single strand overhang, preferably a 3' single strand overhang, or, particularly if single stranded, a 5' modification which includes one or more phosphate groups or one or more analogs of a phosphate group.

An "iRNA agent," as used herein, is an RNA agent which can, or which can be cleaved into an RNA agent which can, down regulate the expression of a target gene, preferably an endogenous or pathogen target RNA. While not wishing to be bound by theory, an iRNA agent may act by one or more of a number of mechanisms, including post-transcriptional cleavage of a target mRNA sometimes referred to in the art as RNAi, or pre-transcriptional or pre-translational mechanisms. An iRNA agent can include a single strand or can include more than one strands, e.g., it can be a double stranded iRNA agent. If the iRNA agent is a single strand it is particularly preferred that it include a 5' modification which includes one or more phosphate groups or one or more analogs of a phosphate group.

The iRNA agent should include a region of sufficient homology to the target gene, and be of sufficient length in terms of nucleotides, such that the iRNA agent, or a fragment thereof, can mediate down regulation of the target gene. (For ease of exposition the term nucleotide or ribonucleotide is sometimes used herein in reference to one or more monomeric subunits of an RNA agent. It will be understood herein that the usage of the term "ribonucleotide" or "nucleotide," herein can, in the case of a modified RNA or nucleotide surrogate, also refer to a modified nucleotide, or surrogate replacement moiety at one or more positions.) Thus, the iRNA agent is or includes a region which is at least partially, and in some embodiments fully, complementary to the target RNA. It is not necessary that there be perfect complementarity between the iRNA agent and the target, but the correspondence must be sufficient to enable the iRNA agent, or a cleavage product thereof, to direct sequence specific silencing, e.g., by RNAi cleavage of the target RNA, e.g., mRNA.

Complementarity, or degree of homology with the target strand, is most critical in the antisense strand. While perfect complementarity, particularly in the antisense strand, is often desired some embodiments can include, particularly in the antisense strand, one or more but preferably 6, 5, 4, 3, 2, or fewer mismatches (with respect to the target RNA). The mismatches, particularly in the antisense strand, are most tolerated in the terminal regions and if present are preferably in a terminal region or regions, e.g., within 6, 5, 4, or 3 nucleotides of the 5' and/or 3' terminus. The sense strand need only be sufficiently complementary with the antisense strand to maintain the overall double strand character of the molecule.

Single stranded regions of an iRNA agent will often be modified or include nucleoside surrogates, e.g., the unpaired region or regions of a hairpin structure, e.g., a region which links two complementary regions, can have modifications or nucleoside surrogates. Modification to stabilize one or more 3'- or 5'-terminus of an iRNA agent, e.g., against exonucleases, or to favor the antisense sRNA agent to enter into RISC are also favored. Modifications can include C3 (or C6, C7, C12) amino linkers, thiol linkers, carboxyl linkers, non-nucleotidic spacers (C3, C6, C9, C12, abasic, triethylene glycol, hexaethylene glycol), special biotin or fluorescein reagents that come as phosphoramidites and that have another DMT-protected hydroxyl group, allowing multiple couplings during RNA synthesis.

iRNA agents include: molecules that are long enough to trigger the interferon response (which can be cleaved by Dicer (Bernstein et al., *Nature* 409:363-366, 2001)) and enter a RISC (RNAi-induced silencing complex); and molecules that are sufficiently short that they do not trigger the interferon response (which molecules can also be cleaved by Dicer and/or enter a RISC), e.g., molecules which are of a size which allows entry into a RISC, e.g., molecules which resemble Dicer-cleavage products. Molecules that are short enough that they do not trigger an interferon response are termed sRNA agents or shorter iRNA agents herein. "sRNA agent or shorter iRNA agent" as used herein, refers to an iRNA agent, e.g., a double stranded RNA agent or single strand agent, that is sufficiently short that it does not induce a deleterious interferon response in a human cell, e.g., it has a duplexed region of less than 60 but preferably less than 50, 40, or 30 nucleotide pairs. The sRNA agent, or a cleavage product thereof, can down regulate a target gene, e.g., by inducing RNAi with respect to a target RNA, preferably an endogenous or pathogen target RNA.

Each strand of a sRNA agent can be equal to or less than 30, 25, 24, 23, 22, 21, or 20 nucleotides in length. The strand is preferably at least 19 nucleotides in length. For example, each strand can be between 21 and 25 nucleotides in length. Preferred sRNA agents have a duplex region of 17, 18, 19, 29, 21, 22, 23, 24, or 25 nucleotide pairs, and one or more overhangs, preferably one or two 3' overhangs, of 2-3 nucleotides.

A "single strand iRNA agent" as used herein, is an iRNA agent which is made up of a single molecule. It may include a duplexed region, formed by intra-strand pairing, e.g., it may be, or include, a hairpin or pan-handle structure. Single strand iRNA agents are preferably antisense with regard to the target molecule. In preferred embodiments single strand iRNA agents are 5' phosphorylated or include a phosphoryl analog at the 5' prime terminus. 5'-phosphate modifications include those which are compatible with RISC mediated gene silencing. Suitable modifications include: 5'-monophosphate ((HO)2(O)P—O-5'); 5'-diphosphate ((HO)2(O)P—O—P(HO)(O)—O-5'); 5'-triphosphate ((HO)2(O)P—O—(HO)(O)P—O—P(HO)(O)—O-5'); 5'-guanosine cap (7-methylated or non-methylated) (7m-G-O-5'-(HO)(O)P—O—(HO)(O)P—O—P(HO)(O)—O-5'); 5'-adenosine cap (Appp), and any modified or unmodified nucleotide cap structure (N—O-5'-(HO)(O)P—O—(HO)(O)P—O—P(HO)(O)—O-5'); 5'-monothiophosphate (phosphorothioate; $(HO)_2(S)P$—O-5'); 5'-monodithiophosphate (phosphorodithioate; (HO)(HS)(S)P—O-5'), 5'-phosphorothiolate $((HO)_2(O)P$—S-5'); any additional combination of oxygen/sulfur replaced monophosphate, diphosphate and triphosphates (e.g. 5'-alpha-thiotriphosphate, 5'-gamma-thiotriphosphate, etc.), 5'-phosphoramidates $((HO)_2(O)P$—NH-5', (HO)(NH2)(O)P—O-5'), 5'-alkylphosphonates (R=alkyl=methyl, ethyl, isopropyl, propyl, etc., e.g. RP(OH)(O)—O-5'-, (OH)2(O)P-5'-CH2-), 5'-alkyletherphosphonates (R=alkylether=methoxymethyl (MeOCH2-), ethoxymethyl, etc., e.g. RP(OH)(O)—O-5'-). (These modifications can also be used with the antisense strand of a double stranded iRNA.)

A single strand iRNA agent should be sufficiently long that it can enter the RISC and participate in RISC mediated cleavage of a target mRNA. A single strand iRNA agent is at least 14, and more preferably at least 15, 20, 25, 29, 35, 40, or 50 nucleotides in length. It is preferably less than 200, 100, or 60 nucleotides in length.

Hairpin iRNA agents will have a duplex region equal to or at least 17, 18, 19, 20, 21, 22, 23, 24, or 25 nucleotide pairs. The duplex region will preferably be equal to or less than 200, 100, or 50, in length. Preferred ranges for the duplex region are 15-30, 17 to 23, 19 to 23, and 19 to 21 nucleotides pairs in length. The hairpin will preferably have a single strand overhang or terminal unpaired region, preferably the 3', and preferably of the antisense side of the hairpin. Preferred overhangs are 2-3 nucleotides in length.

A "double stranded (ds) iRNA agent" as used herein, is an iRNA agent which includes more than one, and preferably two, strands in which interchain hybridization can form a region of duplex structure.

Other suitable modifications to a sugar, base, or backbone of an iRNA agent are described in co-owned PCT Application No. PCT/US2004/01193, filed Jan. 16, 2004. An iRNA agent can include a non-naturally occurring base, such as the bases described in co-owned PCT Application No. PCT/US2004/011822, filed Apr. 16, 2004. An iRNA agent can include a non-naturally occurring sugar, such as a non-carbohydrate cyclic carrier molecule. Exemplary features of non-naturally occurring sugars for use in iRNA agents are described in co-owned PCT Application No. PCT/US2004/11829 filed Apr. 16, 2003.

An mRNA agent can include an internucleotide linkage (e.g., the chiral phosphorothioate linkage) useful for increasing nuclease resistance. In addition, or in the alternative, an iRNA agent can include a ribose mimic for increased nuclease resistance. Exemplary internucleotide linkages and ribose mimics for increased nuclease resistance are described in co-owned PCT Application No. PCT/US2004/07070 filed on Mar. 8, 2004.

An iRNA agent can have a ZXY structure, such as is described in co-owned PCT Application No. PCT/US2004/07070 filed on Mar. 8, 2004.

An iRNA agent can be complexed with an amphipathic moiety. Exemplary amphipathic moieties for use with iRNA agents are described in co-owned PCT Application No. PCT/US2004/07070 filed on Mar. 8, 2004.

In another embodiment, the iRNA agent can be complexed to a delivery agent that features a modular complex. The complex can include a carrier agent linked to one or more of (preferably two or more, more preferably all three of): (a) a condensing agent (e.g., an agent capable of attracting, e.g., binding, a nucleic acid, e.g., through ionic or electrostatic interactions); (b) a fusogenic agent (e.g., an agent capable of fusing and/or being transported through a cell membrane); and (c) a targeting group, e.g., a cell or tissue targeting agent, e.g., a lectin, glycoprotein, lipid or protein, e.g., an antibody, that binds to a specified cell type. iRNA agents complexed to a delivery agent are described in co-owned PCT Application No. PCT/US2004/07070 filed on Mar. 8, 2004.

An iRNA agent can have non-canonical pairings, such as between the sense and antisense sequences of the iRNA duplex. Exemplary features of non-canonical iRNA agents are described in co-owned PCT Application No. PCT/US2004/07070 filed on Mar. 8, 2004.

Many of these types of modifications are provided in the Examples and are described in Tables 3-18.

Design of iRNA. The present invention is based on a gene walk of the VEGF gene to identify active iRNA agents that can be used to reduce the level of VEGF mRNA in a cell. Not all potential iRNA agent sequences in the VEGF gene are active, many of which also having significant off-target effects. The present invention advances the art by selecting those sequences which are active and do not have significant off-target effects. Further, the sequence chosen for the iRNA agents of the present invention are conserved amongst multiple species allowing one to use a single agent for animal and toxicological studies as well as using it for therapeutic purposes in humans.

Based on these results, the invention specifically provides an iRNA agent that can be used in treating VEGF mediated disorders, particularly in the eye such as AMD, in isolated form and as a pharmaceutical composition described below. Such agents will include a sense strand having at least 15 or more contiguous nucleotides that are complementary to the VEGF gene and an antisense strand having at least 15 or more contiguous nucleotides that are complementary to the sense strand sequence. Particularly useful are iRNA agents that have a sense strand that comprises, consist essentially of or consists of a nucleotide sequence provided in Table 1, such as those agents proved in Table 2, or any of the modifications provided in Tables 3-18.

Candidate iRNA agents can be designed by performing, as done herein, a gene walk analysis of the VEGF gene that will serve as the iRNA target. Overlapping, adjacent, or closely spaced candidate agents corresponding to all or some of the transcribed region can be generated and tested. Each of the iRNA agents can be tested and evaluated for the ability to down regulate the target gene expression (see below, "Evaluation of Candidate iRNA agents").

Preferably, the iRNA agents of the present invention are based on and comprise at least 15 or more contiguous nucleotides from one of the iRNA agents shown to be active in Table 2, or the modified sequences provided in Tables 3-18. In such agents, the agent can comprise, consist of or consist essentially of the entire sequence provided in the Table or can comprise 15 or more contiguous residues along with additional nucleotides from contiguous regions of the target gene.

An iRNA agent can be rationally designed based on sequence information and desired characteristics and the information of the target sequence provided in Table 1. For example, an iRNA agent can be designed according to the relative melting temperature of the candidate duplex. Generally, the duplex should have a lower melting temperature at the 5' end of the antisense strand than at the 3' end of the antisense strand.

Accordingly, the present invention provides iRNA agents comprising a sense strand and antisense strand each comprising a sequence of at least 15, 16, 17, 18, 19, 20, 21 or 23 nucleotides which is essentially identical to one of the agents provided in Table 1 or 2.

The antisense strand of an iRNA agent should be equal to or at least, 15, 16, 17, 18, 19, 25, 29, 40, or 50 nucleotides in length. It should be equal to or less than 50, 40, or 30, nucleotides in length. Preferred ranges are 15-30, 17 to 25, 19 to 23, and 19 to 21 nucleotides in length. Exemplified iRNA agents include those that comprise 15 or more nucleotides from one of the agents in Table 2 (or are complementary to the target sequence provided in Table 1) but are not longer than 25 nucleotides in length.

The sense strand of an iRNA agent should be equal to or at least 15, 16 17, 18, 19, 25, 29, 40, or 50 nucleotides in length. It should be equal to or less than 50, 40, or 30 nucleotides in length. Preferred ranges are 15-30, 17 to 25, 19 to 23, and 19 to 21 nucleotides in length. Exemplified iRNA agents include those that comprise 15 or more nucleotides from one of the agents in Table 2 (or the target sequence in Table 2) but are not longer than 25 nucleotides in length.

The double stranded portion of an iRNA agent should be equal to or at least, 15, 16 17, 18, 19, 20, 21, 22, 23, 24, 25, 29, 40, or 50 nucleotide pairs in length. It should be equal to or less than 50, 40, or 30 nucleotides pairs in length. Preferred ranges are 15-30, 17 to 25, 19 to 23, and 19 to 21 nucleotides pairs in length.

The agents provided in Table 2 are 23 nucleotides in length for each strand. The iRNA agents contain a 21 nucleotide double stranded region with a 2 nucleotide overhang on each of the 3' ends of the agent. These agents can be modified as described herein to obtain equivalent agents comprising at least a portion of these sequences (15 or more contiguous nucleotides) and or modifications to the oligonucleotide bases and linkages. Particularly preferred are the modification and agents provided in Tables 3-18.

Generally, the iRNA agents of the instant invention include a region of sufficient complementarity to the VEGF gene and are of sufficient length in terms of nucleotides that the iRNA agent, or a fragment thereof, can mediate down regulation of the VEGF gene. The antisense strands of the iRNA agents of the present invention are preferably fully complementary to the mRNA sequences of VEGF gene. However, it is not necessary that there be perfect complementarity between the iRNA agent and the target, but the correspondence must be sufficient to enable the iRNA agent, or a cleavage product thereof, to direct sequence specific silencing, e.g., by RNAi cleavage of a VEGF mRNA.

Therefore, the iRNA agents of the instant invention include agents comprising a sense strand and antisense strand each comprising a sequence of at least 16, 17 or 18 nucleotides which is essentially identical, as defined below, to one of the sequences of the VEGF gene, such as those agent provided in Table 2, except that not more than 1, 2 or 3 nucleotides per strand, respectively, have been substituted by other nucleotides (e.g. adenosine replaced by uracil), while essentially retaining the ability to inhibit VEGF expression. These agents will therefore possess at least 15 or more nucleotides identical to the VEGF gene but 1, 2 or 3 base mismatches with respect to either the VEGF mRNA sequence or between the sense and antisense strand are introduced. Mismatches to the target VEGF mRNA sequence, particularly in the antisense strand, are most tolerated in the terminal regions and if present are preferably in a terminal region or regions, e.g., within 6, 5, 4, or 3 nucleotides of a 5' and/or 3' terminus, most preferably within 6, 5, 4, or 3 nucleotides of the 5'-terminus of the sense strand or the 3'-terminus of the antisense strand. The sense strand need only be sufficiently complementary with the antisense strand to maintain the overall double stranded character of the molecule.

It is preferred that the sense and antisense strands be chosen such that the iRNA agent includes a single strand or unpaired region at one or both ends of the molecule, such as those exemplified in Table 2 (as well as Tables 3-18). Thus, an iRNA agent contains sense and antisense strands, preferably paired to contain an overhang, e.g., one or two 5' or 3' overhangs but preferably a 3' overhang of 2-3 nucleotides. Most embodiments will have a 3' overhang. Preferred siRNA agents will have single-stranded overhangs, preferably 3' overhangs, of 1 to 4, or preferably 2 or 3 nucleotides, in length, on one or both ends of the iRNA agent. The overhangs can be the result of one strand being longer than the other, or the result of two strands of the same length being staggered. 5'-ends are preferably phosphorylated.

Preferred lengths for the duplexed region is between 15 and 30, most preferably 18, 19, 20, 21, 22, and 23 nucleotides in length, e.g., in the siRNA agent range discussed above. Embodiments in which the two strands of the siRNA agent are linked, e.g., covalently linked are also included. Hairpin, or other single strand structures which provide the required double stranded region, and preferably a 3' overhang are also within the invention.

Synthesis of iRNA Agents. Oligonucleotides (e.g., certain modified oligonucleotides or portions of oligonucleotides lacking ribonucleotides) can be synthesized using protocols known in the art, for example as described in Caruthers et al., *Methods in Enzymology* 211:3, 1992; Thompson et al., International PCT Publication No. WO 99/54459; Wincott et al., *Nucleic Acids Res.* 23:2677, 1995; Wincott et al., *Methods Mol. Bio.* 74:59, 1997; Brennan et al., *Biotechnol. Bioeng.* 61:33, 1998; and Brennan, U.S. Pat. No. 6,001,311. All of these references are incorporated herein by reference. The synthesis of oligonucleotides makes use of common nucleic acid protecting and coupling groups, such as dimethoxytrityl at the 5'-end, and phosphoramidites at the 3'-end.

The method of synthesis used for RNA including certain iRNA agents of the invention follows the procedure as described in Usman et al., *J. Chem. Soc.* 109:7845, 1987; Scaringe et al., *Nucleic Acids Res.* 18:5433, 1990; Wincott et al., *Nucleic Acids Res.* 23:2677, 1995; and Wincott et al., *Methods Mol. Bio.* 74:59, 1997; and makes use of common nucleic acid protecting and coupling groups, such as dimethoxytrityl at the 5'-end, and phosphoramidites at the 3'-end. Detailed descriptions of a variety of synthetic methods to produce modified iRNA agents are provided in the Examples.

Alternatively, the nucleic acid molecules of the present invention can be synthesized separately and joined together post-synthetically, for example, by ligation (Moore et al., *Science* 256:9923, 1992; Draper et al., International PCT publication No. WO 93/23569; Shabarova et al., *Nucleic Acids Res.* 19:4247, 1991; Bellon et al., *Nucleosides & Nucleotides* 16:951, 1997; Bellon et al., *Bioconjugate* 8:204, 1997), or by hybridization following synthesis and/or deprotection.

An iRNA agent can also be assembled from two distinct nucleic acid sequences or fragments wherein one fragment includes the sense region and the second fragment includes the antisense region of the iRNA agent.

iRNA agents can be modified extensively to enhance stability by modification with nuclease resistant groups, for example, 2'-amino, 2'-C-allyl, 2'-fluoro, difluorortoluoyl, 5-allyamino-pyrimidines, 2'-O-methyl, 2'-H (for a review see Usman and Cedergren, *Trends in Biochem. Sci.* 17:34, 1992). iRNA constructs can be purified by gel electrophoresis using general methods or can be purified by high pressure liquid chromatography (HPLC; see Wincott et al., supra, the totality of which is hereby incorporated herein by reference) and re-suspended in water.

In another aspect of the invention, iRNA agents can be expressed from transcription units inserted into DNA or RNA vectors. The recombinant vectors can be DNA plasmids or viral vectors. iRNA agent-expressing viral vectors can be constructed based on, but not limited to, adeno-associated virus, retrovirus, adenovirus, or alphavirus. The recombinant vectors capable of expressing the iRNA agents can be delivered as described herein, and persist in target cells. Alternatively, viral vectors can be used that provide for transient expression of iRNA agents.

Evaluating iRNA agents. Any of the iRNA agents described herein can be evaluated and modified as follows.

An iRNA agent may be susceptible to cleavage by an endonuclease or exonuclease, such as when the iRNA agent is introduced into the body of a subject. Methods can be used to determine sites of cleavage, e.g., endo- and exonucleolytic cleavage on an iRNA agent and to determine the mechanism of cleavage. An iRNA agent can be modified to inhibit such cleavage.

A dsRNA, e.g., an iRNA agent, can be evaluated to identify sites that are susceptible to modification, particularly cleavage, e.g., cleavage by a component found in the body of a subject. The component can be specific for a particular area of the body, such as a particular tissue, organ, or bodily fluid (e.g., blood, plasma, or serum). Sites in an iRNA agent that are susceptible to cleavage, either by endonucleolytic or exonucleolytic cleavage, in certain areas of the body, may be resistant to cleavage in other areas of the body.

A method for evaluating an iRNA agent can include: (1) determining the point or points at which a substance present in the body of a subject, and preferably a component present in a compartment of the body into which a therapeutic dsRNA is to be introduced (this includes compartments into which the therapeutic is directly introduced, e.g., the circulation, as well as in compartments to which the therapeutic is eventually targeted, e.g., the liver or kidney; in some cases, e.g., the eye, the two are the same), cleaves a dsRNA, e.g., an iRNA agent; and (2) identifying one or more points of cleavage, e.g., endonucleolytic, exonucleolytic, or both, in the dsRNA. Optionally, the method further includes providing an RNA (e.g., an iRNA agent) modified to inhibit cleavage at such sites.

The steps described above can be accomplished by using one or more of the following assays:

(i) (a) contacting a candidate dsRNA, e.g., an iRNA agent, with a test agent (e.g., a biological agent),
(b) using a size-based assay, e.g., gel electrophoresis to determine if the iRNA agent is cleaved. In a preferred embodiment a time course is taken and a number of samples incubated for different times are applied to the size-based assay. In preferred embodiments, the candidate dsRNA is not labeled. The method can be a "stains all" method.

(ii) (a) supplying a candidate dsRNA, e.g., an iRNA agent, which is radiolabeled;
(b) contacting the candidate dsRNA with a test agent,
(c) using a size-based assay, e.g., gel electrophoresis to determine if the iRNA agent is cleaved. In a preferred embodiment, a time course is taken where a number of samples are incubated for different times and applied to the size-based assay. In preferred embodiments the determination is made under conditions that allow determination of the number of nucleotides present in a fragment. For example, an incubated sample is run on a gel having markers that allow assignment of the length of cleavage products. The gel can include a standard that is a "ladder" digestion. Either the sense or antisense strand can be labeled. Preferably only one strand is labeled in a particular experiment. The label can be incorporated at the 5' end, 3' end, or at an internal position. Length of a fragment (and thus the point of cleavage) can be determined from the size of the fragment based on the ladder and mapping using a site-specific endonuclease such as RNAse T1.

(iii) Fragments produced by any method, e.g., one described herein, e.g., one of those above, can be analyzed by mass spectrometry. Following contacting the iRNA with the test agent, the iRNA can be purified (e.g., partially purified), such as by phenol-chloroform extraction followed by precipitation. Liquid chromatography can then be used to separate the fragments and mass spectrometry can be used to determine the mass of each fragment. This allows determination of the mechanism of cleavage, e.g., if by direct phosphate cleavage, such as by 5' or 3' exonuclease cleavage, or mediated by the 2'OH via formation of a cyclic phosphate.

In another embodiment, the information relating to a site of cleavage is used to select a backbone atom, a sugar or a base, for modification, e.g., a modification to decrease cleavage.

Exemplary modifications include modifications that inhibit endonucleolytic degradation, including the modifications described herein. Particularly favored modifications include: 2' modification, e.g., a 2'-O-methylated nucleotide or 2'-deoxy nucleotide (e.g., 2' deoxy-cytodine), or a 2'-fluoro, difluorotoluoyl, 5-Me-2'-pyrimidines, 5-allyamino-pyrimidines, 2'-O-methoxyethyl, 2'-hydroxy, or 2'-ara-fluoro nucleotide, or a locked nucleic acid (LNA), extended nucleic acid (ENA), hexose nucleic acid (HNA), or cyclohexene nucleic acid (CeNA). In one embodiment, the 2' modification is on the uridine of at least one 5'-uridine-adenine-3' (5'-UA-3') dinucleotide, at least one 5'-uridine-guanine-3' (5'-UG-3') dinucleotide, at least one 5'-uridine-uridine-3' (5'-UU-3') dinucleotide, or at least one 5'-uridine-cytidine-3' (5'-UC-3') dinucleotide, or on the cytidine of at least one 5'-cytidine-adenine-3' (5'-CA-3') dinucleotide, at least one 5'-cytidine-cytidine-3' (5'-CC-3') dinucleotide, or at least one 5'-cytidine-uridine-3' (5'-CU-3') dinucleotide. The 2' modification can also be applied to all the pyrimidines in an iRNA agent. In one preferred embodiment, the 2' modification is a 2'OMe modification on the sense strand of an iRNA agent. In a more preferred embodiment the 2' modification is a 2' fluoro modification, and the 2' fluoro is on the sense or antisense strand or on both strands.

Modification of the backbone, e.g., with the replacement of an O with an S, in the phosphate backbone, e.g., the provision of a phosphorothioate modification can be used to inhibit endonuclease activity. In some embodiments, an iRNA agent has been modified by replacing one or more ribonucleotides with deoxyribonucleotides. Preferably, adjacent deoxyribonucleotides are joined by phosphorothioate linkages, and the iRNA agent does not include more than four consecutive deoxyribonucleotides on the sense or the antisense strands. Replacement of the U with a C5 amino linker; replacement of an A with a G (sequence changes are preferred to be located on the sense strand and not the antisense strand); or modification of the sugar at the 2', 6', 7', or 8' position can also inhibit endonuclease cleavage of the iRNA agent. Preferred embodiments are those in which one or more of these modifications are present on the sense but not the antisense strand, or embodiments where the antisense strand has fewer of such modifications.

Exemplary modifications also include those that inhibit degradation by exonucleases. Examples of modifications that inhibit exonucleolytic degradation can be found herein. In one embodiment, an iRNA agent includes a phosphorothioate linkage or P-alkyl modification in the linkages between one or more of the terminal nucleotides of an iRNA agent. In another embodiment, one or more terminal nucleotides of an iRNA agent include a sugar modification, e.g., a 2' or 3' sugar modification. Exemplary sugar modifications include, for example, a 2'-O-methylated nucleotide, 2'-deoxy nucleotide (e.g., deoxy-cytodine), 2'-deoxy-2'-fluoro (2'-F) nucleotide, 2'-O-methoxyethyl (2'-O-MOE), 2'-O-aminopropyl (2'-O-AP), 2'-O—N-methylacetamido (2'-O-NMA), 2'-O-dimethylaminoethlyoxyethyl (2'-DMAEOE), 2'-O-dimethylaminoethyl (2'-O-DMAOE), 2'-O-dimethylaminopropyl (2'-O-AP), 2'-hydroxy nucleotide, or a 2'-ara-fluoro nucleotide, or a locked nucleic acid (LNA), extended nucleic acid (ENA), hexose nucleic acid (HNA), or cyclohexene nucleic acid (CeNA). A 2' modification is preferably 2'OMe, more preferably, 2'fluoro.

The modifications described to inhibit exonucleolytic cleavage can be combined onto a single iRNA agent. For example, in one embodiment, at least one terminal nucleotide of an iRNA agent has a phosphorothioate linkage and a 2' sugar modification, e.g., a 2'F or 2'OMe modification. In another embodiment, at least one terminal nucleotide of an iRNA agent has a 5' Me-pyrimidine and a 2' sugar modification, e.g., a 2'F or 2'OMe modification.

To inhibit exonuclease cleavage, an iRNA agent can include a nucleobase modification, such as a cationic modification, such as a 3'-abasic cationic modification. The cationic modification can be, e.g., an alkylamino-dT (e.g., a C6 amino-dT), an allylamino conjugate, a pyrrolidine conjugate, a pthalamido or a hydroxyprolinol conjugate, on one or more of the terminal nucleotides of the iRNA agent. An alkylamino-dT conjugate is preferably attached to the 3' end of the sense or antisense strand of an iRNA agent. A pyrrolidine linker is preferably attached to the 3' or 5' end of the sense strand, or the 3' end of the antisense strand. An allyl amine uridine is preferably on the 3' or 5' end of the sense strand, and not on the 5' end of the antisense strand.

In another embodiment, the iRNA agent includes a conjugate on one or more of the terminal nucleotides of the iRNA agent. The conjugate can be, for example, a lipophile, a terpene, a protein binding agent, a vitamin, a carbohydrate, a retiniod, or a peptide. For example, the conjugate can be naproxen, nitroindole (or another conjugate that contributes to stacking interactions), folate, ibuprofen, cholesterol, retinoids, PEG, or a C5 pyrimidine linker. In other embodiments, the conjugates are glyceride lipid conjugates (e.g. a dialkyl glyceride derivatives), vitamin E conjugates, or thio-cholesterols. Preferably, conjugates are on the 3' end of the antisense strand, or on the 5' or 3' end of the sense strand, and preferably the conjugates are not on the 3' end of the antisense strand and on the 3' end of the sense strand.

In one embodiment, the conjugate is naproxen, and the conjugate is preferably on the 5' or 3' end of the sense or antisense strands. In one embodiment, the conjugate is cholesterol, and the conjugate is preferably on the 5' or 3' end of the sense strand and preferably not present on the antisense strand. In some embodiments, the cholesterol is conjugated to the iRNA agent by a pyrrolidine linker, or serinol linker, aminooxy, or hydroxyprolinol linker. In other embodiments, the conjugate is a dU-cholesterol, or cholesterol is conjugated to the iRNA agent by a disulfide linkage. In another embodiment, the conjugate is cholanic acid, and the cholanic acid is attached to the 5' or 3' end of the sense strand, or the 3' end of the antisense strand. In one embodiment, the cholanic acid is attached to the 3' end of the sense strand and the 3' end of the antisense strand. In another embodiment, the conjugate is PEGS, PEG20, naproxen or retinal.

In another embodiment, one or more terminal nucleotides have a 2'-5' linkage. Preferably, a 2'-5' linkage occurs on the sense strand, e.g., the 5' end of the sense strand.

In one embodiment, the iRNA agent includes an L-sugar, preferably at the 5' or 3' end of the sense strand.

In one embodiment, the iRNA agent includes a methylphosphonate at one or more terminal nucleotides to enhance exonuclease resistance, e.g., at the 3' end of the sense or antisense strands of the iRNA agent.

In one embodiment, an iRNA agent has been modified by replacing one or more ribonucleotides with deoxyribonucleotides. Preferably, adjacent deoxyribonucleotides are joined by phosphorothioate linkages, and the iRNA agent does not include more than four consecutive deoxyribonucleotides on the sense or the antisense strands.

In some embodiments, an iRNA agent having increased stability in cells and biological samples includes a difluorotoluoyl (DFT) modification, e.g., 2,4-difluorotoluoyl uracil, or a guanidine to inosine substitution.

The methods described can be used to select and/or optimize a therapeutic dsRNA, e.g., iRNA agent. dsRNAs, e.g., iRNA agents, made by a method described herein are within the invention.

The methods can be used to evaluate a candidate dsRNA, e.g., a candidate iRNA agent, which is unmodified or which includes a modification, e.g., a modification that inhibits degradation, targets the dsRNA molecule, or modulates hybridization. Such modifications are described herein. A cleavage assay can be combined with an assay to determine the ability of a modified or non-modified candidate to silence the target. For example, one might (optionally) test a candidate to evaluate its ability to silence a target (or off-target sequence), evaluate its susceptibility to cleavage, modify it (e.g., as described herein, e.g., to inhibit degradation) to produce a modified candidate, and test the modified candidate for one or both of the ability to silence and the ability to resist degradation. The procedure can be repeated. Modifications can be introduced one at a time or in groups. It will often be convenient to use a cell-based method to monitor the ability to silence a target RNA. This can be followed by a different method, e.g., a whole animal method, to confirm activity.

The invention includes using information on cleavage sites obtained by a method described herein to modify a dsRNA, e.g., an iRNA agent.

Optimizing the activity of the nucleic acid molecules of the invention Chemically synthesizing nucleic acid molecules with modifications (base, sugar and/or phosphate) can prevent their degradation by serum ribonucleases, which can increase their potency (see e.g., Eckstein et al., International Publication No. WO 92/07065; Perrault et al., Nature 344: 565, 1990; Phieken et al., Science 253:314, 1991; Usman and Cedergren, Trends in Biochem. Sci. 17:334, 1992; Usman et al., International Publication No. WO 93/15187; and Rossi et al., International Publication No. WO 91/03162; Sproat, U.S. Pat. No. 5,334,711; Gold et al., U.S. Pat. No. 6,300,074; and Burgin et al., supra; all of which are incorporated by reference herein). All of the above references describe various chemical modifications that can be made to the base, phosphate and/or sugar moieties of the nucleic acid molecules described herein. Modifications that enhance their efficacy in cells, and removal of bases from nucleic acid molecules to shorten oligonucleotide synthesis times and reduce chemical requirements are desired.

Other suitable modifications to a sugar, base, or backbone of an iRNA agent are described elsewhere herein.

There are several examples in the art describing sugar, base and phosphate modifications that can be introduced into nucleic acid molecules with significant enhancement in their nuclease stability and efficacy. For example, oligonucleotides are modified to enhance stability and/or enhance biological activity by modification with nuclease resistant groups, for example, 2'-amino, 2'-C-allyl, 2'-fluoro, 2'-O-methyl, 2'-O-allyl, 2'-H, nucleotide base modifications (for a review see Usman and Cedergren, Trends in Biochem. Sci. 17:34, 1992; Usman et al., Nucleic Acids Symp. Ser. 31:163, 1994; Burgin et al., Biochemistry 35:14090, 1996). Sugar modification of nucleic acid molecules have been extensively described in the art (see Eckstein et al., International Publication PCT No. WO 92/07065; Perrault et al., Nature 344:565, 1990; Pieken et al. Science 253:314, 1991; Usman and Cedergren, Trends in Biochem. Sci. 17:334, 1992; Usman et al., International Publication PCT No. WO93/15187; Sproat, U.S. Pat. No. 5,334, 711, and Beigelman et al., J. Biol. Chem. 270:25702, 1995; Beigelman et al., International PCT publication No. WO 97/26270; Beigelman et al., U.S. Pat. No. 5,716,824; Usman et al., U.S. Pat. No. 5,627,053; Woolf et al., International PCT Publication No. WO 98/13526; Karpeisky et al., Tetrahedron Lett. 39:1131, 1998; Earnshaw and Gait, Biopolymers (Nucleic Acid Sciences) 48:39, 1998; Verma and Eckstein, Annu. Rev. Biochem. 67:99, 1998; and Burlina et al., Bioorg. Med. Chem. 5:1999, 1997; all of the references are hereby incorporated in their totality by reference herein). Such publications describe general methods and strategies to determine the location of incorporation of sugar, base and/or phosphate modifications and the like into nucleic acid molecules without modulating catalysis, and are incorporated by reference herein. In view of such teachings, similar modifications can be used as described herein to modify the iRNA nucleic acid molecules of the instant invention so long as the ability of iRNA agents to promote RNAi in cells is not significantly inhibited.

While chemical modification of oligonucleotide internucleotide linkages with phosphorothioate, phosphorodithioate, and/or 5'-methylphosphonate linkages improves stability, excessive modifications can cause some toxicity or decreased activity. Therefore, when designing nucleic acid molecules, the amount of these internucleotide linkages should be minimized. The reduction in the concentration of these linkages should lower toxicity, resulting in increased efficacy and higher specificity of these molecules.

The 3' and 5' ends of an iRNA agent can be modified. Such modifications can be at the 3' end, 5' end or both ends of the molecule. They can include modification or replacement of an entire terminal phosphate or of one or more of the atoms of the phosphate group. For example, the 3' and 5' ends of an oligonucleotide can be conjugated to other functional molecular entities such as labeling moieties, e.g., fluorophores (e.g., pyrene, TAMRA, fluorescein, Cy3 or Cy5 dyes) or protecting groups (based e.g., on sulfur, silicon, boron or ester). The functional molecular entities can be attached to the sugar through a phosphate group and/or a spacer. The terminal atom of the spacer can connect to or replace the linking atom of the phosphate group or the C-3' or C-5' O, N, S or C group of the sugar. Alternatively, the spacer can connect to or replace the terminal atom of a nucleotide surrogate (e.g., PNAs). These spacers or linkers can include e.g., —(CH2)n-, —(CH2)nN—, —(CH2)nO—, —(CH2)nS—, O(CH2CH2O)nCH2CH2OH (e.g., n=3 or 6), abasic sugars, amide, carboxy, amine, oxyamine, oxyimine, thioether, disulfide, thiourea, sulfonamide, or morpholino, or biotin and fluorescein reagents. When a spacer/phosphate-functional molecular entity-spacer/phosphate array is interposed between two sequences of an iRNA agent, the array can substitute for a hairpin RNA loop in a hairpin-type RNA agent. The 3' end can be an —OH group. While not wishing to be bound by theory, it is believed that conjugation of certain moieties can improve transport, hybridization, and specificity properties. Again, while not wishing to be bound by theory, it may be desirable to introduce terminal alterations that improve nuclease resistance. Other examples of terminal modifications include dyes, intercalating agents (e.g., acridines), cross-linkers (e.g., psoralene, mitomycin C), porphyrins (TPPC4, texaphyrin, Sapphyrin), polycyclic aromatic hydrocarbons (e.g., phenazine, dihydrophenazine), artificial endonucleases (e.g., EDTA), lipophilic carriers (e.g., cholesterol, cholic acid, adamantane acetic acid, 1-pyrene butyric acid, dihydrotestosterone, 1,3-Bis-O (hexadecyl)glycerol, geranyloxyhexyl group, hexadecylglycerol, borneol, menthol, 1,3-propanediol, heptadecyl group, palmitic acid, myristic acid, O3-(oleoyl)lithocholic acid, O3-(oleoyl)cholenic acid, dimethoxytrityl, or phenoxazine) and peptide conjugates (e.g., antennapedia peptide, Tat peptide), alkylating agents, phosphate, amino, mercapto, PEG (e.g., PEG-40K), MPEG, [MPEG]2, polyamino, alkyl, substituted alkyl, radiolabeled markers, enzymes, haptens (e.g., biotin), transport/absorption facilitators (e.g., aspirin, vitamin E, folic acid), and synthetic ribonucleases (e.g., imidazole, bisimidazole, histamine, imidazole clusters, acridine-imidazole conjugates, Eu3+ complexes of tetraazamacrocycles). In some embodiments, conjugates such as retinol or retinoic acid can be attached to the 5' or 3' end, or both ends, of an iRNA agent. Use of such conjugates may improve specific uptake and delivery of iRNA agents to cells that express retinol receptors, such as retinal pigment epithelial cells.

Terminal modifications can be added for a number of reasons, such as to modulate activity or to modulate resistance to degradation. Terminal modifications useful for modulating activity include modification of the 5' end with phosphate or phosphate analogs. For example, in preferred embodiments iRNA agents, especially antisense sequences, are 5' phosphorylated or include a phosphoryl analog at the 5' prime terminus. 5'-phosphate modifications include those which are compatible with RISC mediated gene silencing. Suitable modifications include: 5'-monophosphate ((HO)2(O)P—O—5'); 5'-diphosphate ((HO)2(O)P—O—P(HO)(O)—O-5'); 5'-triphosphate ((HO)2(O)P—O—(HO)(O)P—O—P(HO)(O)—O-5'); 5'-guanosine cap (7-methylated or non-methylated) (7 m-G-O-5'-(HO)(O)P—O—(HO)(O)P—O—P(HO)(O)—O-5'); 5'-adenosine cap (Appp), and any modified or unmodified nucleotide cap structure (N—O-5'-(HO)(O)P—O—(HO)(O)P—O—(HO)(O)—O-5'); 5'-monothiophosphate (phosphorothioate; (HO)2(S)P—O-5'); 5'-monodithiophosphate (phosphorodithioate; (HO)(HS)(S)P—O-5'), 5'-phosphorothiolate ((HO)2(O)P—S-5'); any additional combination of oxygen/sulfur replaced monophosphate, diphosphate and triphosphates (e.g., 5'-alpha-thiotriphosphate, 5'-gamma-thiotriphosphate, etc.), 5'-phosphoramidates ((HO)2(O)P—NH-5', (HO)(NH2)(O)P—O-5'), 5'-alkylphosphonates (R=alkyl=methyl, ethyl, isopropyl, propyl, etc., e.g., RP(OH)(O)—O-5'-, (OH)$_2$(O)P-5'-CH2-), 5'-alkyletherphosphonates (R=alkylether=methoxymethyl (MeOCH2-), ethoxymethyl, etc., e.g., RP(OH)(O)—O-5'-).

In another embodiment, the invention features conjugates and/or complexes of iRNA agents of the invention. Such conjugates and/or complexes can be used to facilitate delivery of iRNA agents into a biological system, such as a cell. The conjugates and complexes provided by the instant invention can impart therapeutic activity by transferring therapeutic compounds across cellular membranes, altering the pharmacokinetics, and/or modulating the localization of nucleic acid molecules of the invention. The present invention encompasses the design and synthesis of novel conjugates and complexes for the delivery of molecules, including, but not limited to, small molecules, lipids, phospholipids, nucleosides, nucleotides, nucleic acids, antibodies, toxins, negatively charged polymers and other polymers, for example, proteins, peptides, hormones, carbohydrates, polyethylene glycols, or polyamines, across cellular membranes. In general, the transporters described are designed to be used either individually or as part of a multi-component system, with or without degradable linkers. These compounds are expected to improve delivery and/or localization of nucleic acid molecules of the invention into a number of cell types originating from different tissues, in the presence or absence of serum (see Sullenger and Cech, U.S. Pat. No. 5,854,038). Conjugates of the molecules described herein can be attached to biologically active molecules via linkers that are biodegradable, such as biodegradable nucleic acid linker molecules.

Administration of the iRNA Agents A patient who has been diagnosed with a disorder characterized by unwanted VEGF expression can be treated by administration of an iRNA agent described herein to block the negative effects of VEGF, thereby alleviating the symptoms associated with unwanted VEGF gene expression. For example, the iRNA agent can alleviate symptoms associated with a disease of the eye, such as a neovascular disorder. In other examples, the iRNA agent can be administered to treat a patient who has a tumor or metastatic cancer, such as colon or breast cancer; a pulmonary disease, such as asthma or bronchitis; or an autoimmune disease such as rheumatoid arthritis or psoriasis. The anti-VEGF iRNA agents can be administered systemically, e.g., orally or by intramuscular injection or by intravenous injection, in admixture with a pharmaceutically acceptable carrier adapted for the route of administration. An iRNA agent can comprise a delivery vehicle, including liposomes, for administration to a subject, carriers and diluents and their salts, and/or can be present in pharmaceutically acceptable formulations. Methods for the delivery of nucleic acid molecules are described in Akhtar et al., *Trends in Cell Bio.* 2:139, 1992; *Delivery Strategies for Antisense Oligonucleotide Therapeutics*, ed. Akhtar, 1995; Maurer et al., *Mol. Membr. Biol.*, 16:129, 1999; Hofland and Huang, *Handb. Exp. Pharmacol.* 137:165, 1999; and Lee et al., *ACS Symp. Ser.* 752:184, 2000, all of which are incorporated herein by reference. Beigelman et al., U.S. Pat. No. 6,395,713 and Sullivan et al., PCT WO 94/02595 further describe the general methods for delivery of nucleic acid molecules. Nucleic acid molecules can be administered to cells by a variety of methods known to those of skill in the art, including, but not restricted to, encapsulation in liposomes, by ionophoresis, or by incorporation into other vehicles, such as hydrogels, cyclodextrins (see for example Gonzalez et al., *Bioconjugate Chem.* 10:1068, 1999), biodegradable nanocapsules, and bioadhesive microspheres, or by proteinaceous vectors (O'Hare and Normand, International PCT Publication No. WO 00/53722).

In the present methods, the iRNA agent can be administered to the subject either as naked iRNA agent, in conjunction with a delivery reagent, or as a recombinant plasmid or viral vector which expresses the iRNA agent. Preferably, the iRNA agent is administered as naked iRNA.

The iRNA agent of the invention can be administered to the subject by any means suitable for delivering the iRNA agent to the cells of the tissue at or near the area of unwanted VEGF expression, such as at or near an area of neovascularization. For example, the iRNA agent can be administered by gene gun, electroporation, or by other suitable parenteral administration routes.

Suitable enteral administration routes include oral delivery.

Suitable parenteral administration routes include intravascular administration (e.g., intravenous bolus injection, intravenous infusion, intra-arterial bolus injection, intra-arterial infusion and catheter instillation into the vasculature); peri- and intra-tissue injection (e.g., intraocular injection, intra-retinal injection, or sub-retinal injection); subcutaneous injection or deposition including subcutaneous infusion (such as by osmotic pumps); direct application to the area at or near the site of neovascularization, for example by a catheter or other placement device (e.g., a retinal pellet or an implant comprising a porous, non-porous, or gelatinous material). It is preferred that injections or infusions of the iRNA agent be given at or near the site of neovascularization.

The iRNA agent of the invention can be delivered using an intraocular implant. Such implants can be biodegradable and/or biocompatible implants, or may be non-biodegradable implants. The implants may be permeable or impermeable to the active agent, and may be inserted into a chamber of the eye, such as the anterior or posterior chambers, or may be implanted in the sclera, transchoroidal space, or an avascularized region exterior to the vitreous. In a preferred embodiment, the implant may be positioned over an avascular region, such as on the sclera, so as to allow for transcleral diffusion of the drug to the desired site of treatment, e.g., the intraocular space and macula of the eye. Furthermore, the site of transcleral diffusion is preferably in proximity to the macula.

The iRNA agent of the invention can also be administered topically, for example, by patch or by direct application to the eye, or by iontophoresis. Ointments, sprays, or droppable liquids can be delivered by ocular delivery systems known in the art such as applicators or eyedroppers. The compositions can be administered directly to the surface of the eye or to the interior of the eyelid. Such compositions can include mucomimetics such as hyaluronic acid, chondroitin sulfate, hydroxypropyl methylcellulose or poly(vinyl alcohol), preservatives such as sorbic acid, EDTA or benzylchronium chloride, and the usual quantities of diluents and/or carriers.

The iRNA agent of the invention may be provided in sustained release compositions, such as those described in, for example, U.S. Pat. Nos. 5,672,659 and 5,595,760. The use of immediate or sustained release compositions depends on the nature of the condition being treated. If the condition consists of an acute or over-acute disorder, treatment with an immediate release form will be preferred over a prolonged release composition. Alternatively, for certain preventative or long-term treatments, a sustained release composition may be appropriate.

An iRNA agent can be injected into the interior of the eye, such as with a needle or other delivery device.

The iRNA agent of the invention can be administered in a single dose or in multiple doses. Where the administration of the iRNA agent of the invention is by infusion, the infusion can be a single sustained dose or can be delivered by multiple infusions. Injection of the agent directly into the tissue is at or near the site of neovascularization is preferred. Multiple injections of the agent into the tissue at or near the site of neovascularization are also preferred.

Dosage levels on the order of about 1 μg/kg to 100 mg/kg of body weight per administration are useful in the treatment of the neovascular diseases. When administered directly to the eye, the preferred dosage range is about 0.00001 mg to about 3 mg per eye, or preferrably about 0.0001-0.001 mg per eye, about 0.03-3.0 mg per eye, about 0.1-3.0 mg per eye or about 0.3-3.0 mg per eye. One skilled in the art can also readily determine an appropriate dosage regimen for administering the iRNA agent of the invention to a given subject. For example, the iRNA agent can be administered to the subject once, e.g., as a single injection or deposition at or near the neovascularization site. Alternatively, the iRNA agent can be administered once or twice daily to a subject for a period of from about three to about twenty-eight days, more preferably from about seven to about ten days. In a preferred dosage regimen, the iRNA agent is injected at or near a site of unwanted VEGF expression (such as near a site of neovascularization) once a day for seven days. Where a dosage regimen comprises multiple administrations, it is understood that the effective amount of iRNA agent administered to the subject can comprise the total amount of iRNA agent administered over the entire dosage regimen. One skilled in the art will appreciate that the exact individual dosages may be adjusted somewhat depending on a variety of factors, including the specific iRNA agent being administered, the time of administration, the route of administration, the nature of the formulation, the rate of excretion, the particular disorder being treated, the severity of the disorder, the pharmacodynamics of the iRNA agent, and the age, sex, weight, and general health of the patient. Wide variations in the necessary dosage level are to be expected in view of the differing efficiencies of the various routes of administration. For instance, oral administration generally would be expected to require higher dosage levels than administration by intravenous or intravitreal injection. Variations in these dosage levels can be adjusted using standard empirical routines of optimization, which are well-known in the art. The precise therapeutically effective dosage levels and patterns are preferably determined by the attending physician in consideration of the above-identified factors.

In addition to treating pre-existing neovascular diseases, iRNA agents of the invention can be administered prophylactically in order to prevent or slow the onset of these and related disorders. In prophylactic applications, an iRNA of the invention is administered to a patient susceptible to or otherwise at risk of a particular neovascular disorder.

The iRNA agents featured by the invention are preferably formulated as pharmaceutical compositions prior to administering to a subject, according to techniques known in the art. Pharmaceutical compositions of the present invention are characterized as being at least sterile and pyrogen-free. As used herein, "pharmaceutical formulations" include formulations for human and veterinary use. Methods for preparing pharmaceutical compositions of the invention are within the skill in the art, for example as described in *Remington's Pharmaceutical Science,* 18th ed., Mack Publishing Company, Easton, Pa. (1990), and *The Science and Practice of Pharmacy,* 2003, Gennaro et al., the entire disclosures of which are herein incorporated by reference.

The present pharmaceutical formulations comprise an iRNA agent of the invention (e.g., 0.1 to 90% by weight), or a physiologically acceptable salt thereof, mixed with a physiologically acceptable carrier medium. Preferred physiologically acceptable carrier media are water, buffered water, normal saline, 0.4% saline, 0.3% glycine, hyaluronic acid and the like.

Pharmaceutical compositions of the invention can also comprise conventional pharmaceutical excipients and/or additives. Suitable pharmaceutical excipients include stabilizers, antioxidants, osmolality adjusting agents, buffers, and pH adjusting agents. Suitable additives include physiologically biocompatible buffers (e.g., tromethamine hydrochloride), additions of chelants (such as, for example, DTPA or DTPA-bisamide) or calcium chelate complexes (as for example calcium DTPA, CaNaDTPA-bisamide), or, optionally, additions of calcium or sodium salts (for example, calcium chloride, calcium ascorbate, calcium gluconate or calcium lactate). Pharmaceutical compositions of the invention can be packaged for use in liquid form, or can be lyophilized.

For solid compositions, conventional non-toxic solid carriers can be used; for example, pharmaceutical grades of mannitol, lactose, starch, magnesium stearate, sodium saccharin, talcum, cellulose, glucose, sucrose, magnesium carbonate, and the like.

For example, a solid pharmaceutical composition for oral administration can comprise any of the carriers and excipients listed above and 10-95%, preferably 25%-75%, of one or more iRNA agents of the invention.

By "pharmaceutically acceptable formulation" is meant a composition or formulation that allows for the effective distribution of the nucleic acid molecules of the instant invention in the physical location most suitable for their desired activity. Non-limiting examples of agents suitable for formulation with the nucleic acid molecules of the instant invention include: P-glycoprotein inhibitors (such as PluronicP85), which can enhance entry of drugs into the CNS (Jolliet-Riant and Tillement, *Fundam. Clin. Pharmacol.* 13:16, 1999); biodegradable polymers, such as poly (DL-lactide-coglycolide) microspheres for sustained release delivery. Other non-limiting examples of delivery strategies for the nucleic acid molecules of the instant invention include material described in Boado et al., *J. Pharm. Sci.* 87:1308, 1998; Tyler et al., *FEBS Lett.* 421:280, 1999; Pardridge et al., *PNAS USA.* 92:5592, 1995; Boado, *Adv. Drug Delivery Rev.* 15:73, 1995; Aldrian-Herrada et al., *Nucleic Acids Res.* 26:4910, 1998; and Tyler et al., *PNAS USA* 96:7053, 1999.

The invention also features the use of the composition comprising surface-modified liposomes containing poly (ethylene glycol) lipids (PEG-modified, or long-circulating liposomes or stealth liposomes). These formulations offer a method for increasing the accumulation of drugs in target tissues. This class of drug carriers resists opsonization and elimination by the mononuclear phagocytic system (MPS or RES), thereby enabling longer blood circulation times and enhanced tissue exposure for the encapsulated drug (Lasic et al., *Chem. Rev.* 95:2601, 1995; Ishiwata et al., *Chem. Phare. Bull.* 43:1005, 1995).

Such liposomes have been shown to accumulate selectively in tumors, presumably by extravasation and capture in the neovascularized target tissues (Lasic et al., *Science* 267:1275, 1995; Oku et al., *Biochim. Biophys. Acta* 1238:86, 1995). The long-circulating liposomes enhance the pharmacokinetics and pharmacodynamics of DNA and RNA, particularly compared to conventional cationic liposomes which are known to accumulate in tissues of the MPS (Liu et al., *J. Biol. Chem.* 42:24864, 1995; Choi et al., International PCT Publication No. WO 96/10391; Ansell et al., International PCT Publication No. WO 96/10390; Holland et al., International PCT Publication No. WO 96/10392). Long-circulating liposomes are also likely to protect drugs from nuclease degradation to a greater extent compared to cationic liposomes, based on their ability to avoid accumulation in metabolically aggressive MPS tissues such as the liver and spleen.

The present invention also includes compositions prepared for storage or administration that include a pharmaceutically effective amount of the desired compounds in a pharmaceutically acceptable carrier or diluent. Acceptable carriers or diluents for therapeutic use are well known in the pharmaceutical art, and are described, for example, in *Remington's Pharmaceutical Sciences*, Mack Publishing Co. (A. R. Gennaro edit. 1985), hereby incorporated by reference herein. For example, preservatives, stabilizers, dyes and flavoring agents can be provided. These include sodium benzoate, sorbic acid and esters of p-hydroxybenzoic acid. In addition, antioxidants and suspending agents can be used.

The nucleic acid molecules of the present invention can also be administered to a subject in combination with other therapeutic compounds to increase the overall therapeutic effect. The use of multiple compounds to treat an indication can increase the beneficial effects while reducing the presence of side effects.

Alternatively, certain iRNA agents of the instant invention can be expressed within cells from eukaryotic promoters (e.g., Izant and Weintraub, *Science* 229:345, 1985; McGarry and Lindquist, *Proc. Natl. Acad. Sci. USA* 83:399, 1986; Scanlon et al., *Proc. Natl. Acad. Sci. USA* 88:10591, 1991; Kashani-Sabet et al., *Antisense Res. Dev.* 2:3, 1992; Dropulic et al., *J. Virol.* 66:1432, 1992; Weerasinghe et al., *J. Virol.* 65:5531, 1991; Ojwang et al., *Proc. Natl. Acad. Sci. USA* 89:10802, 1992; Chen et al., *Nucleic Acids Res.* 20:4581, 1992; Sarver et al., *Science* 247:1222, 1990; Thompson et al., *Nucleic Acids Res.* 23:2259, 1995; Good et al., *Gene Therapy* 4:45, 1997). Those skilled in the art realize that any nucleic acid can be expressed in eukaryotic cells from the appropriate DNA/RNA vector. The activity of such nucleic acids can be augmented by their release from the primary transcript by a enzymatic nucleic acid (Draper et al., PCT WO 93/23569, and Sullivan et al., PCT WO 94/02595; Ohkawa et al., *Nucleic Acids Symp. Ser.* 27:156, 1992; Taira et al., *Nucleic Acids Res.* 19:5125, 1991; Ventura et al., *Nucleic Acids Res.* 21:3249, 1993; Chowrira et al., *J. Biol. Chem.* 269:25856, 1994).

In another aspect of the invention, RNA molecules of the present invention can be expressed from transcription units (see for example Couture et al., *Trends in Genetics* 12:510, 1996) inserted into DNA or RNA vectors. The recombinant vectors can be DNA plasmids or viral vectors. iRNA agent-expressing viral vectors can be constructed based on, but not limited to, adeno-associated virus, retrovirus, adenovirus, or alphavirus. In another embodiment, pol III based constructs are used to express nucleic acid molecules of the invention (see for example Thompson, U.S. Pat. Nos. 5,902,880 and 6,146,886). The recombinant vectors capable of expressing the iRNA agents can be delivered as described above, and persist in target cells. Alternatively, viral vectors can be used that provide for transient expression of nucleic acid molecules. Such vectors can be repeatedly administered as necessary. Once expressed, the iRNA agent interacts with the target mRNA and generates an RNAi response. Delivery of iRNA agent-expressing vectors can be systemic, such as by intravenous or intra-muscular administration, by administration to target cells ex-planted from a subject followed by reintroduction into the subject, or by any other means that would allow for introduction into the desired target cell (for a review see Couture et al., *Trends in Genetics* 12:510, 1996).

Additional ophthalmic indications for the iRNA agents of the invention include proliferative diabetic retinopathy (the most severe stage of diabetic retinopathy), uveitis (an inflammatory condition of the eye that often leads to macular edema), cystoid macular edema following cataract surgery, myopic degeneration (a condition in which a patient with a high degree of nearsightedness develops choroidal neovascularization), inflammatory macular degeneration (a condition in which a patient with inflammation in the macular area due to infections or other causes, develops choroidal neovascularization), and iris neovascularization (a serious complication of diabetic retinopathy or retinal vein occlusion involving new blood vessel growth on the surface of the iris).

Additional non-ophthalmic indications for the iRNA agents of the invention include cancer, including but not limited to renal and colon cancer, and psoriasis. Solid tumors and their metastases rely on new blood vessel growth for their survival.

Psoriasis is a chronic inflammatory skin disease that causes skin cells to grow too quickly, resulting in thick white or red patches of skin. Preclinical and clinical data suggest that VEGF-induced blood vessel growth and blood vessel leakage play a role in the development of this condition.

The invention is further illustrated by the following examples, which should not be construed as further limiting.

EXAMPLES

Example 1 siRNA Design

Four hundred target sequences were identified within exons 1-5 of the VEGF-A121 mRNA sequence (See Table 1, SEQ ID NOs 2-401) and corresponding siRNAs targeting these subjected to a bioinformatics screen.

To ensure that the sequences were specific to VEGF sequence and not to sequences from any other genes, the target sequences were checked against the sequences in Genbank using the BLAST search engine provided by NCBI. The use of the BLAST algorithm is described in Altschul et al., *J. Mol. Biol.* 215:403, 1990; and Altschul and Gish, *Meth. Enzymol.* 266:460, 1996.

siRNAs were also prioritized for their ability to cross react with monkey, rat and human VEGF sequences.

Of these 400 potential target sequences 80 were selected for analysis by experimental screening in order to identify a small number of lead candidates. A total of 114 siRNA molecules were designed for these 80 target sequences 114 (Table 2).

Example 2

Synthesis of the siRNA Oligonucleotides

RNA was synthesized on Expedite 8909, ABI 392 and ABI394 Synthesizers (Applied Biosystems, Applera Deutschland GmbH, Frankfurter Str. 129b, 64293 Darmstadt, Germany) at 1 μmole scale employing CPG solid support and Expedite RNA phosphoramidites (both from Proligo Biochemie GmbH, Georg-Hyken-Str.14, Hamburg, Germany). Ancillary reagents were obtained from Mallinckrodt Baker (Im Leuschnerpark 4:64347 Griesheim, Germany). Phosphorothioate linkages were introduced by replacement of the iodine oxidizer solution with a solution of the Beaucage reagent in acetonitrile (5% weight per volume).

Cleavage of the oligoribonucleotides from the solid support and base deprotection was accomplished with a 3:1 (v/v) mixture of methylamine (41%) in water and methylamine (33%) in ethanol. 2'-Desilylation was carried out according to established procedures (Wincott et al., *Nucleic Acids Res.* 23:2677-2684, 1995). Crude oligoribonucleotides were purified by anion exchange HPLC using a 22×250 mm DNAPac PA 100 column with buffer A containing 10 mM NaClO$_4$, 20 mM Tris, pH 6.8, 6 M urea and buffer B containing 400 mM NaClO$_4$, 20 mM Tris, pH 6.8, 6 M Urea. Flow rate was 4.5 mL/min starting with 15% Buffer B which was increased to 55% over 45 minutes.

The purified compounds were characterized by LC/ESI-MS (LC: Ettan Micro, Amersham Biosciences Europe GmbH, Munzinger Strasse 9, 79111 Freiburg, Germany, ESI-MS: LCQ, Deca XP, Thermo Finnigan, Im Steingrund 4-6, 63303 Dreieich, Germany) and capillary electrophoresis (P/ACE MDQ Capillary Electrophoresis System, Beckman Coulter GmbH, 85702 Unterschleißheim, Germany). Purity of the isolated oligoribonucleotides was at least 85%.

Yields and concentrations were determined by UV absorption of a solution of the respective RNA at a wavelength of 260 nm using a spectral photometer. Double stranded RNA was generated by mixing an equimolar solution of complementary strands in annealing buffer (20 Mm Sodium Phosphate, pH 6.8; 100 Mm Sodium Chloride), Heating in a Water Bath at 85-90° C. for 3 minutes and cooling to room temperature over a period of 3-4 hours. The RNA was kept at −20° C. until use.

Example 3

Efficacy Screen of siRNAs

Using two efficacy screens, the VEGF siRNA were screened for their ability to become a lead candidate. Table 2 shows the relative efficiencies of some of the siRNAs in their ability to inhibit expression of an endogenous VEGF gene. In this process the number of candidate siRNAs was winnowed. Human HeLa or ARPE-19 (human retinal pigment epithelial cell line with differentiated properties (Dunn et al., *Exp. Eye Res.* 62:155, 1996) were plated in 96-well plates (17,000 cells/well) in 100 μl 10% fetal bovine serum in Dulbecco's Modified Eagle Medium (DMEM). When the cells reached approximately 90% confluence (approximately 24 hours later) they were transfected with serial three-fold dilutions of siRNA starting at 20 nM 0.4 μl of transfection reagent Lipofectamine™ 2000 (Invitrogen Corporation, Carlsbad, Calif.) was used per well and transfections were performed according to the manufacturer's protocol. Namely, the siRNA: Lipofectamine™ 2000 complexes were prepared as follows. The appropriate amount of siRNA was diluted in Opti-MEM I Reduced Serum Medium without serum and mixed gently. The Lipofectamine™ 2000 was mixed gently before use, then for each well of a 96 well plate, 0.4 μl was diluted in 25 μl of Opti-MEM I Reduced Serum Medium without serum and mixed gently and incubated for 5 minutes at room temperature. After the 5 minute incubation, 1 μl of the diluted siRNA was combined with the diluted Lipofectamine™ 2000 (total volume is 26.4 μl). The complex was mixed gently and incubated for 20 minutes at room temperature to allow the siRNA: Lipofectamine™ 2000 complexes to form. Then 100 μl of 10% fetal bovine serum in DMEM was added to each of the siRNA:Lipofectamine™ 2000 complexes and mixed gently by rocking the plate back and forth. 100 μl of the above mixture was added to each well containing the cells and the plates were incubated at 37° C. in a CO$_2$ incubator for 24 hours, then the culture medium was removed and 100 μl 10% fetal bovine serum in DMEM was added. Following the medium change, conditioned medium was collected at 24 hours (HeLa cells) or 72 hours (ARPE-19 cells) and a human VEGF ELISA was performed using the DuoSet human VEGF ELISA Development kit (R&D Systems, Inc. Minneapolis, Minn. 55413). This kit contains the basic component required for the development of sandwich ELISAs to measure natural and recombinant human VEGF in cell culture supernatants and serum.

The materials used included:

Capture Antibody—576 μg/ml of goat anti-human VEGF when reconstituted with 0.25 ml PBS (137 mM NaCl, 2.7 mM KCl, 8.1 mM Na$_2$HPO$_4$, 1.5 mM KH$_2$PO$_4$, pH 7.2-7.4, 0.2 μm filtered). After reconstitution, stored at 2-8° C. for up to 60 days or aliquoted and stored at −20° C. to −70° C. in a manual defrost freezer for up to 6 months. Diluted to a working concentration of 0.8 μg/ml in PBS without carrier protein.

Detection antibody—4.5 µg/ml of biotinylated goat anti-human VEGF when reconstituted with 1.0 ml of Reagent Diluent (1% bovine serum albumin in PBS, pH 7.2-7.4, 0.2 µm filtered. After reconstitution, stored at 2-8° C. for up to 60 days or aliquoted and stored at −20° C. to −70° C. in a manual defrost freezer for up to 6 months. Diluted to a working concentration of 25 ng/ml in Reagent Diluent.

Standard: 110 ng/ml of recombinant when reconstituted with 0.5 ml of Reagent Diluent. Allowed the standard to sit for a minimum of 15 minutes with gentle agitation prior to making dilutions. The reconstituted Standard can be stored at 2-8° C. for up to 60 days or aliquoted and stored at −20° C. to −70° C. in a manual defrost freezer for up to 6 months. A seven point standard curve using 2-fold serial dilutions in Reagent Diluent, and a high standard of 4000 pg/ml is recommended.

Streptavidin-HRP: 1.0 ml of streptavidin conjugated to horseradish-peroxidase. Stored at 2-8° C. for up to 6 months. Diluted to the working concentration specified on the vial label.

General ELISA protocol was followed (R&D Systems, Inc., Minneapolis, Minn.).

Controls included no siRNA, human VEGF siRNA (Cand5, (a.k.a., hVEGF5) Reich et al., *Mol. Vis.* 9:210, 2003) and an siRNA matching a 21-nt sequence conserved between the human, rat and mouse VEGF (hrmVEGF, Filleur et al., *Cancer Res.* 63:3919-3922, 2003).

The activities of the siRNAs were compared to the activity of the control human VEGF siRNA of Reich et al. (supra) with "+" representing a lower activity, "++" representing similar activity and "+++" representing a higher activity than the control human VEGF siRNA (Table 2). FIG. 2 shows the activities of single- and double-overhang siRNAs in HeLa cells. Solid lines with filled symbols represent the single-overhang siRNA, solid lines with open symbols represent the double-overhang siRNAs; dashed lines represent the control siRNAs. All of the siRNAs are more active than the control siRNAs and may inhibit expression of VEGF by approximately 80%. In contrast, the siRNA from Reich et al. (supra) reduced the level of endogenous hVEGF by approximately 20% under the same experimental conditions. Similarly, under the same experimental conditions, the siRNA based on consensus sequence hrmVEGF (Filleur et al., supra) reduced the expression level by approximately 45%.

Figure 3:
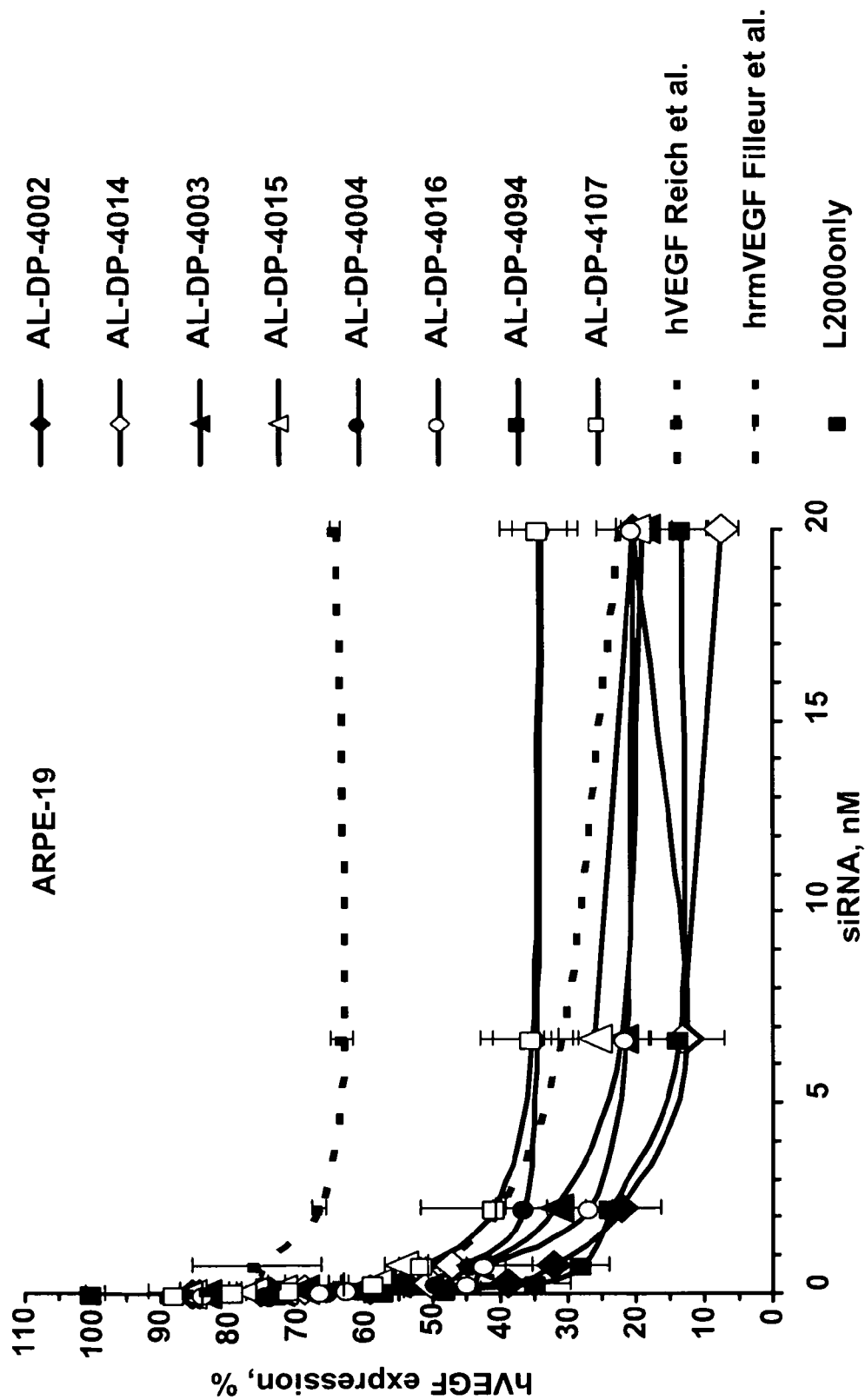
FIG. 3 is a graphical representation of a comparative analysis of the activities of single- and double-overhang siRNAs in ARPE-19 cells. Solid lines with filled symbols represent the single-overhang siRNA; solid lines with open symbols represent the double-overhang siRNAs; dashed lines represent the control siRNAs. The control siRNA hVEGF is described in Reich et al. (*Mol. Vis.* 9:210, 2003); the control siRNA hrmVEGF is described in Filleur et al. (supra). "L2000" refers to Lipofectamine 2000 reagent. hVEGF expression (y-axis) refers to endogenous VEGF expression.

FIG. 3 shows the activities of single- and double-overhang siRNAs in ARPE-19 cells. Solid lines with filled symbols represent the single-overhang siRNA, solid lines with open symbols represent the double-overhang siRNAs; dashed lines represent the control siRNAs. All of the siRNAs are more active than the control siRNAs and may inhibit expression of VEGF by approximately 90%. In contrast, the siRNA from Reich et al. (*Mol. Vis.* 9:210, 2003) reduced the level of hVEGF by approximately 35% under the same experimental conditions. Similarly, under the same experimental conditions, the siRNA based on consensus sequence hrmVEGF (Filleur et al., supra) reduced the expression level by approximately 70%.

Figure 4:
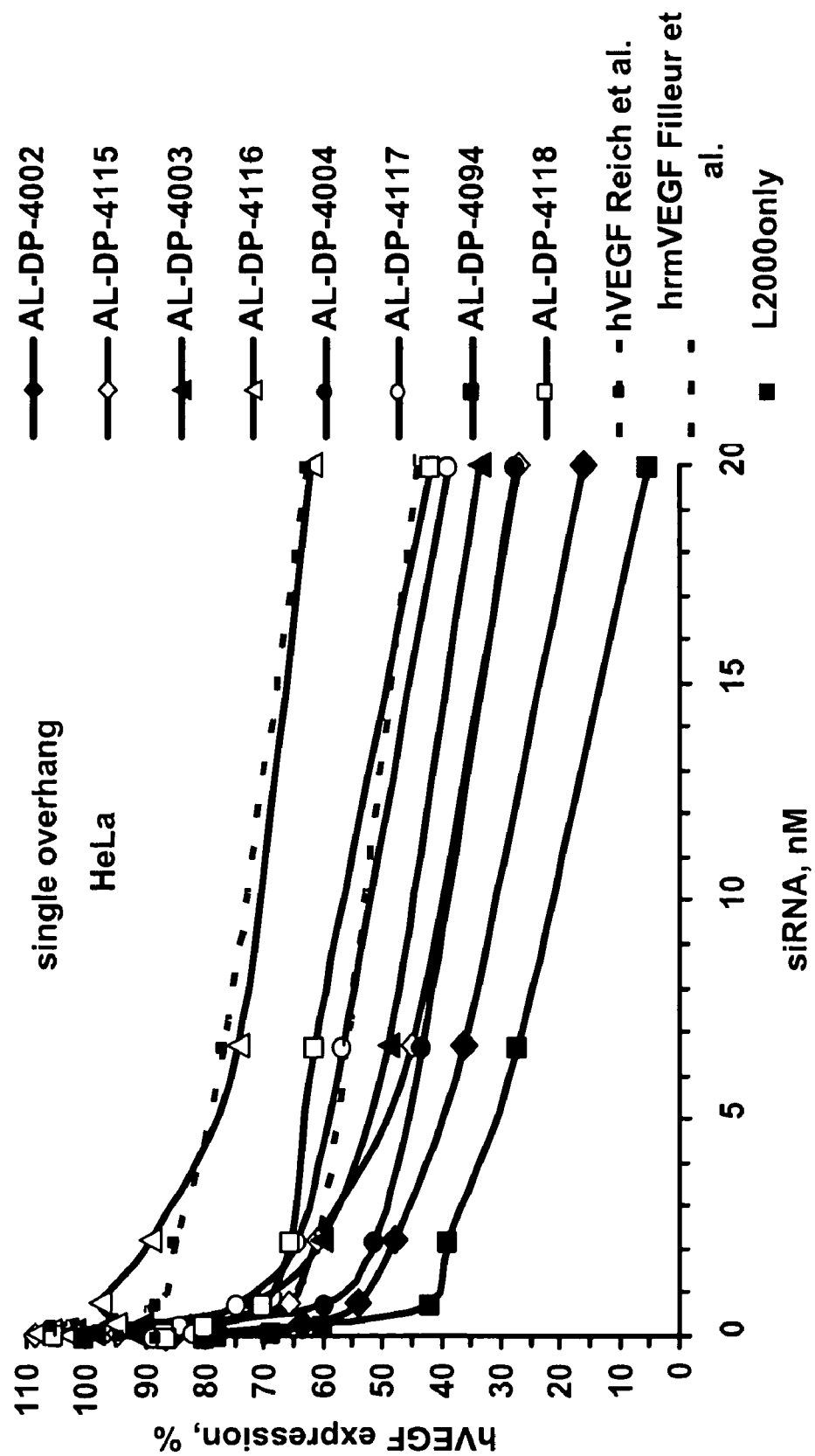
FIG. 4 is a graphical representation of a comparative analysis of the siRNAs activities in HeLa cells of single-overhang siRNAs with their analogous blunt siRNAs in which the number of base-paired nucleotides is 21. The control siRNA hVEGF is described in Reich et al. (*Mol. Vis.* 9:210, 2003); the control siRNA hrmVEGF is described in Filleur et al. (supra). "L2000" refers to Lipofectamine 2000 reagent. hVEGF expression (y-axis) refers to endogenous VEGF expression.
Figure 5:
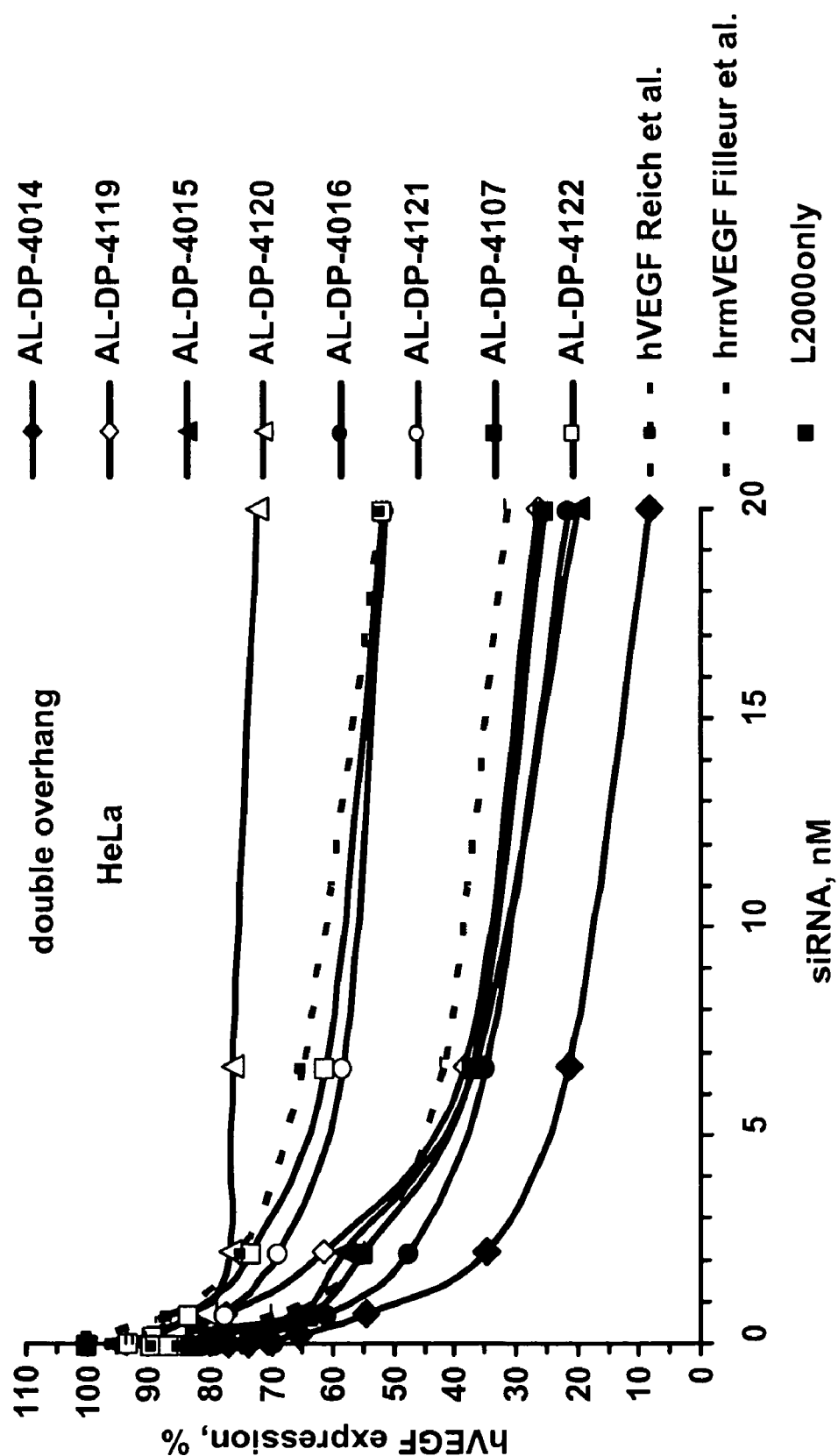
FIG. 5 is a graphical representation of a comparative analysis of the siRNAs activities in HeLa cells of double-overhang siRNAs with their analogous blunt siRNAs in which the number of base-paired nucleotides is 19. The control siRNA hVEGF is described in Reich et al. (supra); the control siRNA hrmVEGF is described in Filleur et al. (supra). "L2000" refers to Lipofectamine 2000 reagent. hVEGF expression (y-axis) refers to endogenous VEGF expression.

FIGS. 4 and 5 show the results of a comparison of single- and double-overhang siRNAs with their analogous blunt-ended siRNAs, respectively in HeLa cells. The results are in agreement with the data of Elbashir et al. (*Genes & Development* 15:188, 2001) in that the presence of an overhang in an siRNA confers greater efficiency in inhibition of gene silencing. However, it is important to note that the activity of the blunt ended siRNAs are comparable to the results achieved using the control siRNAs.

Example 4

In Vitro Assay for the Silencing of VEGF Synthesis Under Hypoxic Conditions

Human HeLa cells were plated in 96 well plates at 10,000 cells/well in 100 µl of growth medium (10% FBS in DMEM). 24 hours post cell seeding when the cells had reached approximately 50% confluence they were transfected with serial three fold dilutions of siRNA starting at 30 nM. 0.2 µof Lipofectamine™ 2000 transfection reagent (Invitrogen Corporation, Carlsbad Calif.) was used per well and transfections were carried out as described in the Invitrogen product insert. Controls included no siRNA, human VEGF siRNA (Reich et al., *Mol. Vis.* 9:210, 2003) and an siRNA matching a 21-nt sequence conserved between the human, rat and mouse VEGF (hrmVEGF, Filleur et al., *Cancer Res.* 63:3919-3922, 2003). Transfections were done in duplicate on each plate. Additionally, duplicate plates were transfected so that 24 hours post transfection the growth media could be changed and one plate could be kept in normal oxygen growth conditions (37° C., 5% $CO_2$, 20% oxygen) and the duplicate plate could be kept in hypoxic conditions (37° C., 1% oxygen, balance nitrogen). Hypoxic conditions were maintained by using a Pro-ox Oxygen Controller (BioSpherix, Ltd., Redfield, N.Y.) attached to a Pro-ox in vitro culture chamber. Cells were maintained in either normoxic or hypoxic conditions for 24 hours post media change. Conditioned culture media was then collected from both plates and tested for secreted VEGF levels in a DuoSet VEGF ELISA (R&D Systems, Minneapolis, Minn.). The assays were performed according to the manufacturer's protocol and as described in Example 2.

For deferoxamine chemically induced hypoxia, 130 µM deferoxamine (Sigma D9533), was used. Deferoxamine was added to the fresh growth media 24 hours post-transfection. Cells treated with deferoxamine were then grown under normal growth conditions (37° C., 5% $CO_2$, 20% oxygen).

Figure 6B:
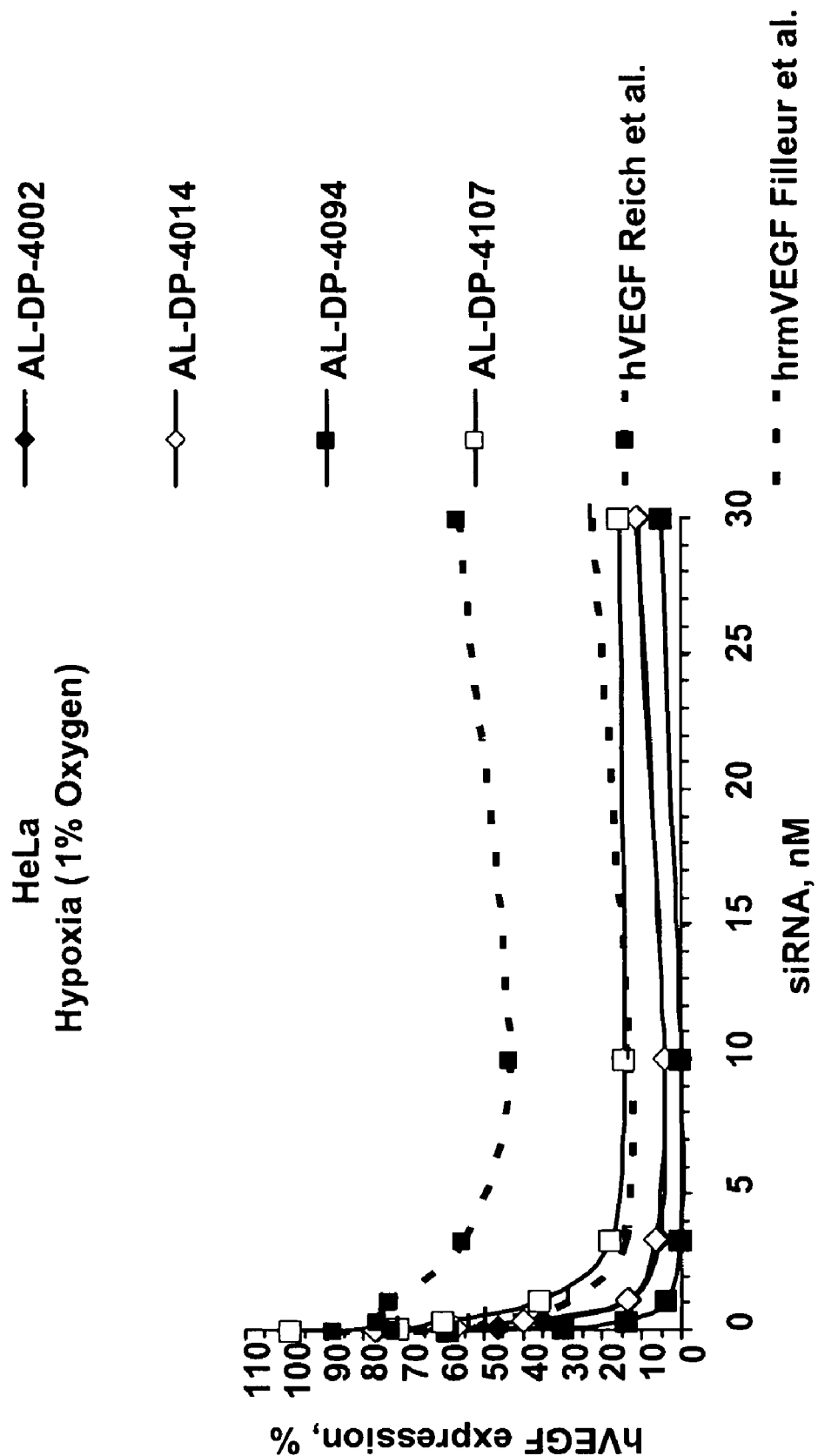
FIG. 6B is a graphical representation of the activities of single-overhang and double overhang siRNAs targeting ORF 319 (SEQ ID NO:320) (AL-DP-4002 and AL-DP-4014, respectively) and ORF 343 (SEQ ID NO:344) (AL-DP-4094 and AL-DP-4107, respectively) in cells under hypoxic conditions (1% oxygen).
Figure 6C:
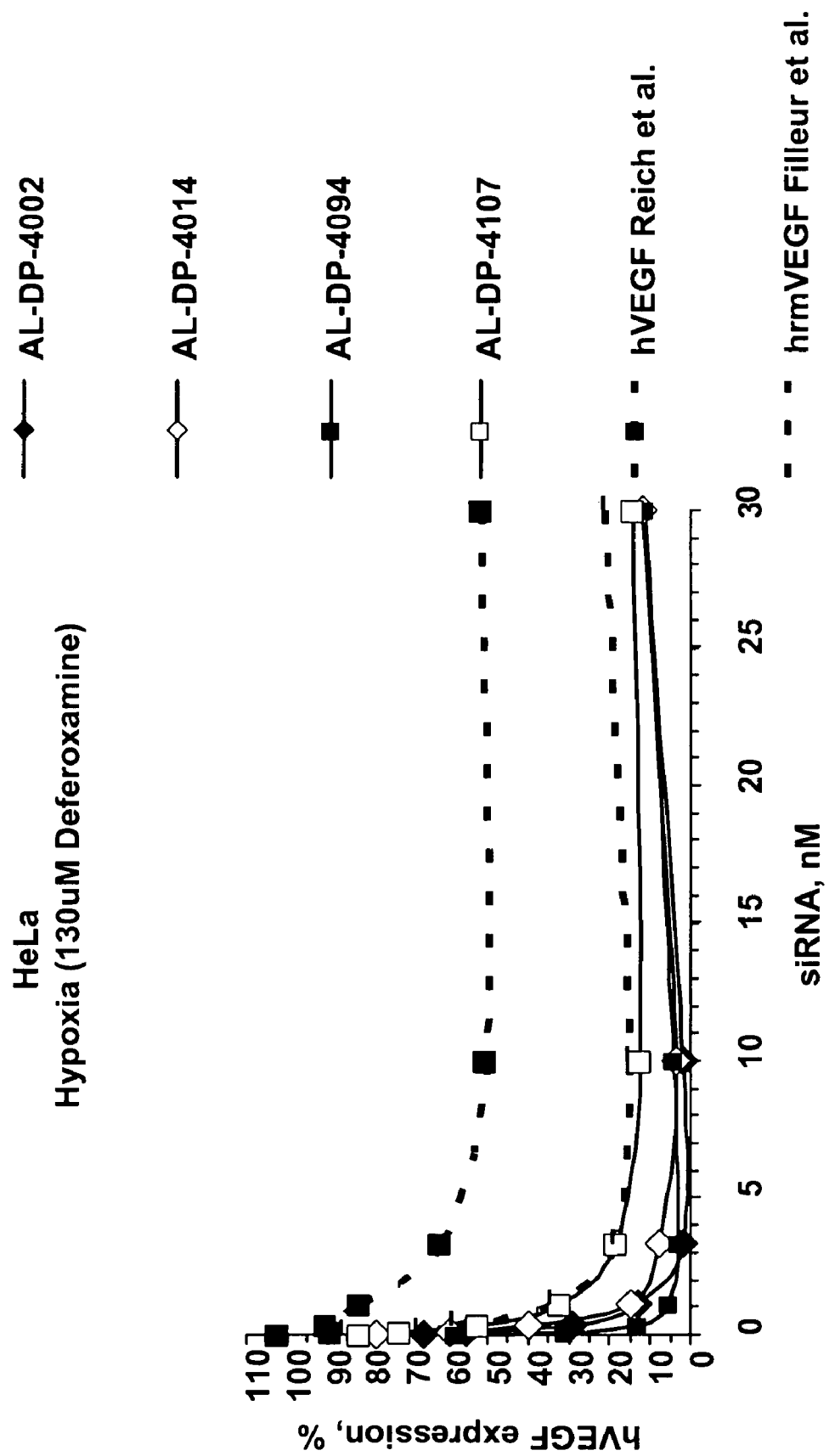
FIG. 6C is a graphical representation of the activities of single-overhang and double overhang siRNAs targeting ORF 319 (SEQ ID NO:320) (AL-DP-4002 and AL-DP-4014, respectively) and ORF 343 (SEQ ID NO:344) (AL-DP-4094 and AL-DP-4107, respectively) in cells under hypoxic conditions (130 µM defoxamine).

FIG. 6 shows the results obtained with siRNAs (both single overhang siRNAs and double overhangs siRNAs) directed against ORF regions having the first nucleotides corresponding to 319 and 343 respectively, together with the control siRNAs. Under hypoxic conditions, either 1% oxygen (FIG. 6B) or 130 µM deferoxamine (FIG. 6C), three of the experimental siRNAs achieved almost 95% inhibition of expression of VEGF, namely AL-DP-4094 (single-overhang) directed at ORF 343, and both of the siRNAs (single and double-overhangs) directed at ORF 319. The control siRNAs of Reich et al (supra) and Filleur et al. (supra) demonstrate an ability to inhibit VEGF expression by 45% and 85% respectively.

Figure 8A:
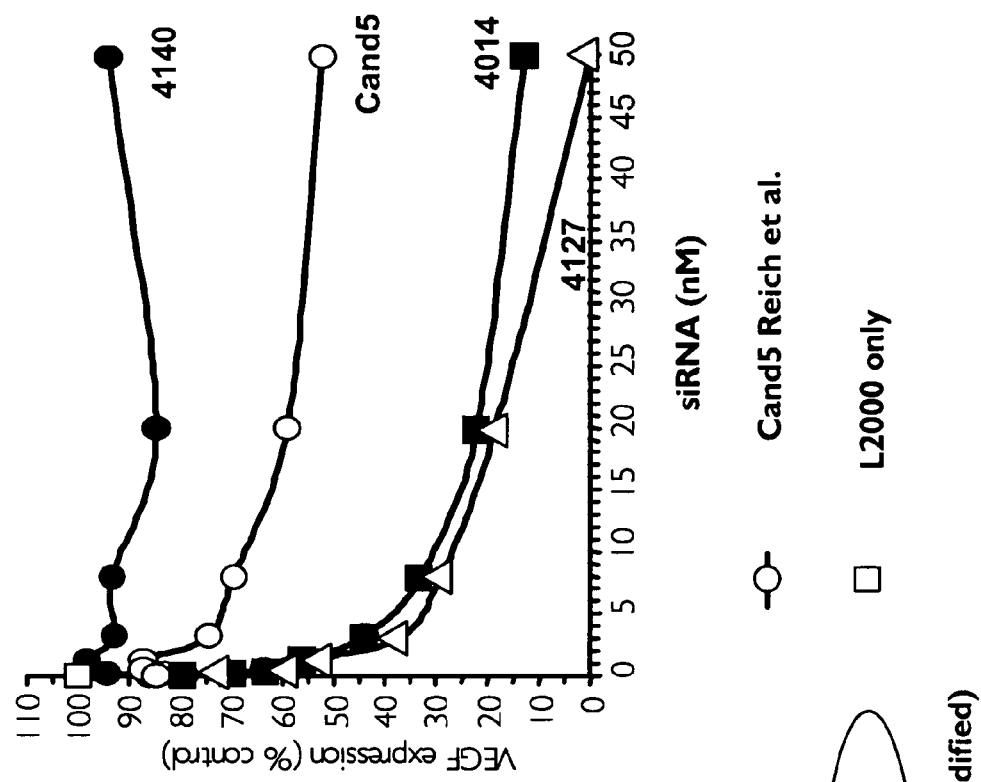
FIG. 8A is a graphical representation of the activities of siRNAs targeting ORF 319 (SEQ ID NO:320) (AL-DP-4014 and AL-DP-4127) and a mutated version AL-DP-4140 (Table 5) in cells under normal oxygen conditions (normoxia, 20% oxygen). The control siRNA Cand5 is identical to the hVEGF control of FIG. 7 and is described in Reich et al. (supra). "L2000" refers to Lipofectamine 2000 reagent. VEGF expression (y-axis) refers to endogenous VEGF expression.
Figure 8B:
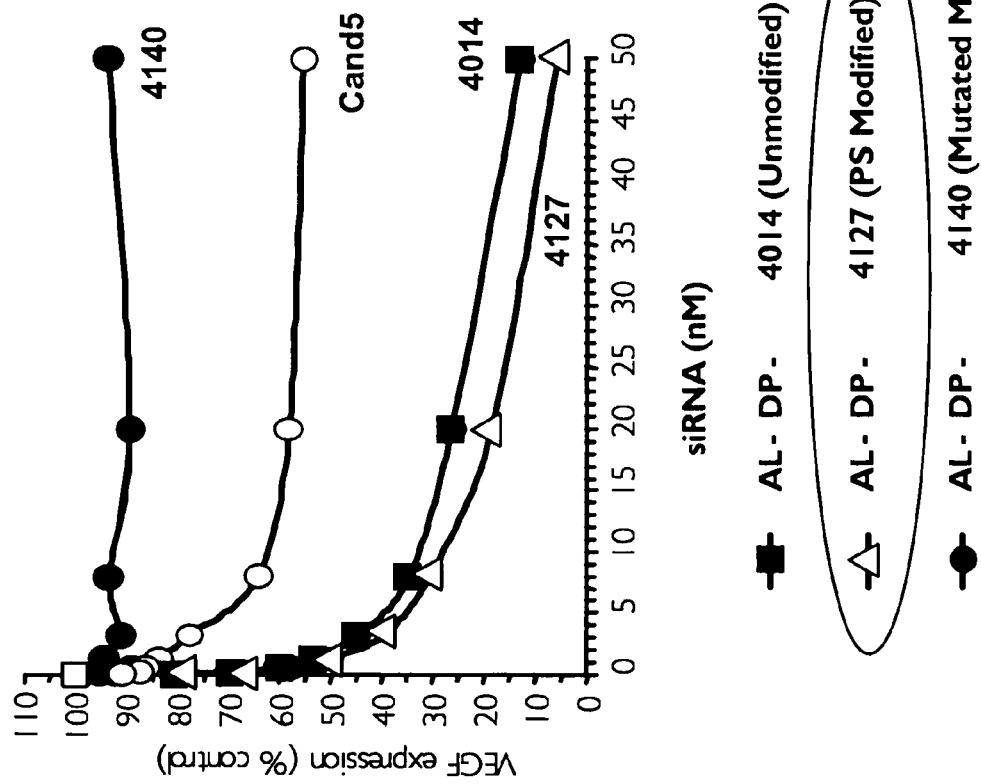
FIG. 8B is a graphical representation of the activities of siRNAs targeting ORF 319 (SEQ ID NO:320) (AL-DP-4014 and AL-DP-4127) and a mutated version AL-DP-4140 (Table 5) in cells under normal or hypoxic conditions (hypoxia, 1% Oxygen). The control siRNAs are as described for FIG. 8A.
Figure 9D:
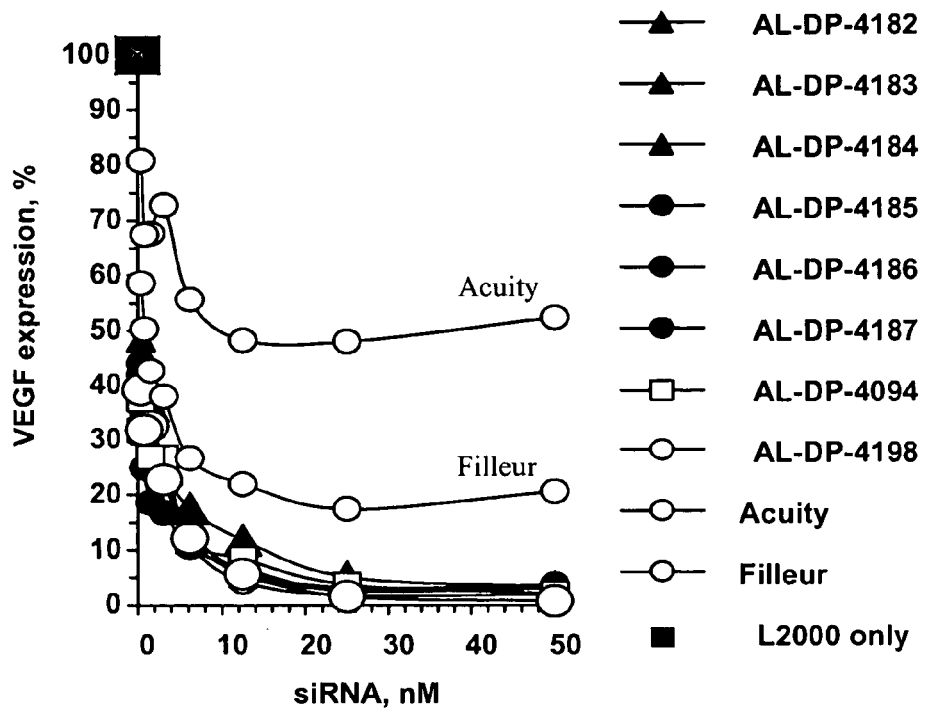

FIGS. 8A and 8B show the results obtained with the siRNAs AL-DP-4014, a phosphorothioate modified version of AL-DP-4014 (AL-DP-4127, see Table 3) and a mutated version of AL-DP-4014 (AL-DP-4140, see Table 5). Under both normal and hypoxic conditions, the unmodified (AL-DP-4014) and the phosphorothioate-modified siRNA (AL-DP-4127) reduced endogenous VEGF expression to less than 20% of its original expression level. Under hypoxic conditions, the phosphorothioate-modified siRNA essentially abolished VEGF expression.

Example 5

Modified VEGF siRNA Molecules Retain Full Activity and Show Enhanced Stability

Figure 7:
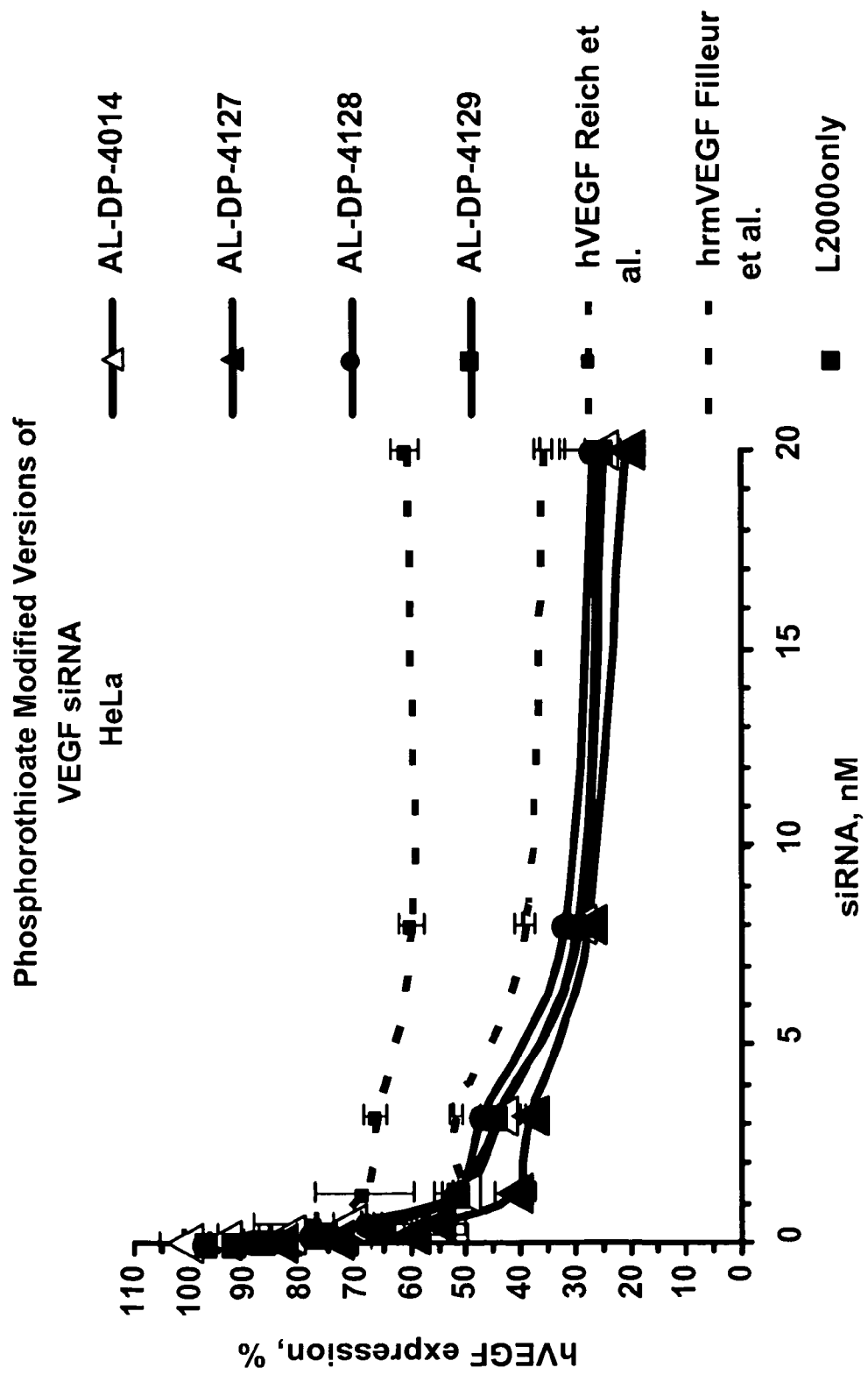
FIG. 7 is a graphical representation of the comparative activities of double-overhang (AL-DP-4014) unmodified siRNA and phosphorothioate-modified (AL-DP-4127, AL-DP-4128, AL-DP-4129) siRNAs targeting ORF 319 (SEQ ID NO:320) in HeLa cells. The control siRNA hVEGF is described in Reich et al. (supra); the control siRNA hrmVEGF is described in Filleur et al. (supra). "L2000" refers to Lipofectamine 2000 reagent. hVEGF expression (y-axis) refers to endogenous VEGF expression.

Phosphorothioate derivatives were made for the AL-DP-4014, targeting ORF 319 of VEGF, and are presented in Table 3. These siRNAs were tested in the HeLa cell assay described in Example 3, and FIG. 7 shows that these derivatives are as active in the HeLa assay as the unmodified siRNA.

Figure 10:
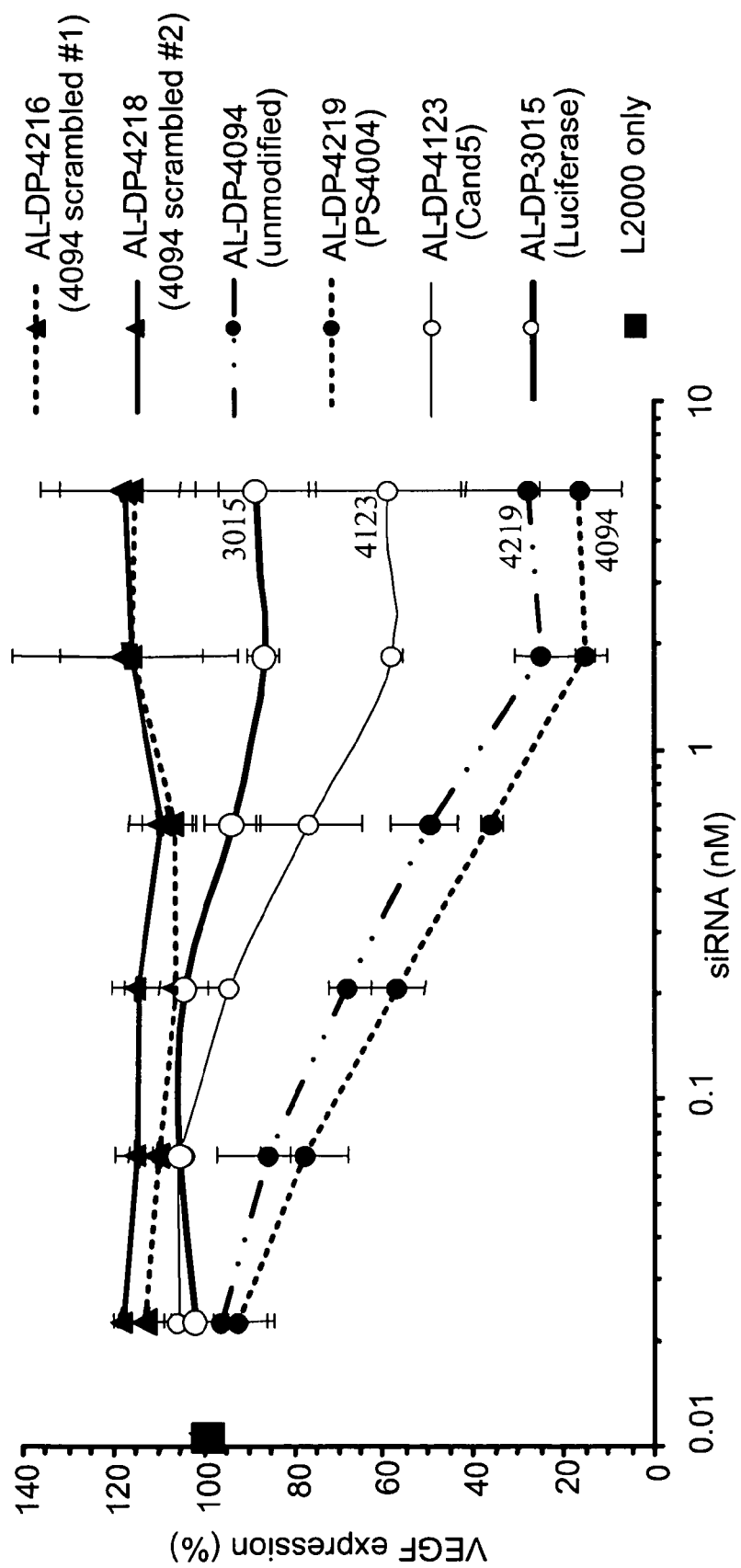
FIG. 10 is a graphical representation of siRNA silencing activity in vitro in HeLa cells.

A panel of siRNAs were synthesized that retained the sequence of the AL-DP-4094 siRNA (Table 1) but included different modifications including phosphorothioate linkages, O-methyl-modified nucleotides, and 2'-fluoro-modified nucleotides (Table 4). The panel of siRNAs was tested in HeLa cells, and FIGS. 9A-9E demonstrate that all modified versions of the AL-DP-4094 siRNA effectively reduced VEGF expression by greater than 90%, exhibiting greater efficacy than either of the two previously identified VEGF siRNAs ("Acuity" in Reich et al. (supra), and "Filleur" in Filleur et al. (supra)). FIG. 10 also shows data from in vitro assays in HeLa cells. The graph in FIG. 10 shows that the unmodified AL-DP-4094 siRNA and a phosphorothioate-modified AL-DP-4004 siRNA (AL-DP-4219) reduced VEGF expression by more than 70% (FIG. 10). Scrambled versions of the compound AL-DP-4094 (e.g., AL-DP-4216 and AL-DP-4218 (sequences shown below; underlined nucleotides represent mismatched nucleotides as compared to AL-DP-4094)) did not inhibit VEGF expression. An siRNA targeting the firefly luciferase gene (AL-DP-3015; see below) also did not inhibit VEGF expression.

```
AL-DP-4216
                                       (SEQ ID NO:995)
AL4094 MI s  5'-GCACAUUGGACAGUUGUGGUU-3'
                                       (SEQ ID NO:995)
AL4094 MI as '3-GUCGUGUAACCUGUCAACACCAA-'5

AL4094 M5
                                       (SEQ ID NO:608)
AL-DP-4218 s 5'-GCACAUAGAAGUGACGCGCUU-3'
                                       (SEQ ID NO:609)
AL4094 M5 as '3-GUCGUGUAUCUUCACUGCGCGAA-'5

AL-DP-3015
                                       (SEQ ID NO:830)
5'-GAACUGUGUGUGAGAGGUCCU-3'
                                       (SEQ ID NO:831)
'3-CGCUUGACACACACUCUCCAGGA-'5
```

The Stains-All technique (Sigma, St. Louis, Mo.) was performed to examine the stability of the modified siRNAs. To perform the assay, an siRNA duplex was incubated in 90% human serum at 37° C. Samples of the reaction mix were quenched at various time points (at 0, 0.25, 1, 2, 4, and 24 hours) and subjected to polyacrylamide gel electrophoresis. Cleavage of the RNA over the time course provided information regarding the susceptibility of the siRNA duplex to serum nuclease degradation.

O-methyl and 2' fluoro modifications used in combination with phosphorothioate modifications were found to enhance stability to a greater extent than when phosphorothioate modifications were used alone. For example, modified versions of the AL-DP-4094 siRNA included a phosphorothioate-modified siRNA (AL-DP-4198), a phosphorothioate plus O-methyl modified siRNAs (e.g., AL-DP-4180, AL-DP-4175, and AL-DP-4220), and phosphorothioate plus O-methyl plus 2'-fluoro modified siRNAs (e.g., AL-DP-4197 and AL-DP-4221) (Table 4). The AL-DP-4180, AL-DP-4175, and AL-DP-4197 siRNAs were found to be more stable in human serum than the AL-DP-4198 siRNA. It was determined that the phosphorothioate modification stabilized the siRNAs against exonucleolytic degradation, and the O-methyl and 2'-fluoro modifications stabilized the siRNAs against endonucleolytic degradation.

Example 6

In Vitro Stability Assay of VEGF siRNAs in Different Rat Serum and Ocular Tissues 1. Preparation of Tissue Homogenates Tissues from pooled whole eyes, retinas, vitreous humors from at least three rats were excised and frozen immediately in liquid nitrogen. The frozen tissue was pulverized over dry ice, using instruments that were pre-chilled on dry ice. 1 ml of RIPA buffer (50 mM Tris-HCl, pH 8.0, 150 mM NaCL, 1 mM Na2EDTA, 0.5% Na-deoxycholate deoxycholic acid, 1% IGEPAL CA-630, 0.05% SDS) was added to the frozen tissue powder and the mixture was mixed thoroughly and vigorously. The homogenate was centrifuged at 10,000×g for 5 min at 4° C. and the pellet was discarded. 100 µl aliquots of the supernatant were transferred to pre-chilled microcentrifuge tubes and stored at −70° C. or used immediately in the stability assay.

2. 5'-End Labeling of Single Stranded Sense or Antisense siRNA Using T4 Polynucleotide Kinase and $\gamma^{32}$P-ATP The following reagents were used:
T4 Polynucleotide Kinase (PNK) 10 units/µl (New England Biolabs, Beverly, Mass.)
10×T4 PNK buffer (700 mM Tris-HCl, 100 mM MgCl$_2$, 50 mM Dithiothreitol (DTT), pH7.6)
Gamma-$^{32}$P-ATP (PerkinElmer, Shelton, Conn.) 250 µCi, 3000 Ci/mmol (3.3 µM)
10 µM stocks of synthetic RNA oligo diluted in H$_2$O
Microspin Sephadex™ G-25 columns (Amersham Biosciences
RNAse-free Water and 0.65 ml microcentrifuge (1.5 ml) tubes A 25 µl kinase reaction contained:
2.5 µl from 10 µM stock sense or antisense (1 µM final conc.)
2.5 µl 10×PNK Buffer (1×)
1.5 µl $\gamma^{32}$-ATP (approximately 0.2 nM)
1.0 µl 10 unit/µl T4 PNK (10 units)
17.5 µl dH$_2$O The reaction mix was incubated at 37° C. for 1 hour (water bath) prior to fractionating the labeled siRNA through Sephadex™ G-25 spin columns (Amersham). 0.5 µL was used to determine the number of counts per minute (cpm)/ml of the radiolabeled sample.

3. Partial Alkaline Hydrolysis Ladder of Radiolabeled Single-Stranded siRNA

To generate a sample of size markers a portion of the 5' $\gamma^{32}$P-end-labeled siRNA was subjected to alkaline hydrolysis as follows:
30 µl hydrolysis reaction containing 2.5 µl 5' end-labeled siRNA (sense or antisense), 6.0 µl 0.5M Na$_2$CO$_3$/NaHCO$_3$ (pH 9.5), 1.5 µl 10 mg/ml tRNA, and 20.0 µl dH$_2$O was incubated at 90° C. for 7.5 min, then chilled on ice or at 4° C. 30 µl of 90% formamide, 50 mM Na$_2$EDTA, 10 mM DTT, and XC&BB (xylene cyanol and bromophenol blue), of which 1 µl+4 µl formamide dye was used for the gel electrophoretic analysis.

4. Annealing of Radiolabeled 1 µM Stock siRNA Duplexes

30 µl 1 µM stock of different siRNA duplexes were prepared in which either the sense strand or the antisense strand was radiolabeled.

The samples were heated at 90° C. for 2 min and then incubated at 37° C. for 1 hour and then stored at −20° C. until used.

5. Quality Control of siRNA Duplex:

Samples of the siRNA duplex were analyzed by electrophoresis through 15% polyacrylamide in Tris-Borate, EDTA (TBE) Gel. Electrophoresis was performed at 150V for 1 hour prior to running the samples through. Samples were prepared by mixing 0.5-1 µl siRNA duplex or single stranded, 3-3.5 µl 0.5×TBE, 1 µl 5× native loading dye (total volume=5 µl).

6. Stability Reactions

2 µl siRNA duplex was added to 18 µl serum or tissue lysate or buffer control in PCR tube (0.2 ml). A zero time point sample was removed immediately following the addition of the siRNA duplex by removing 2 µl and adding it to 18 µl 90% formamide, 50 mM EDTA, 10 mM DTT and xylene cyanol and bromophenol blue (XC & BB). Other samples were removed after 15 min, 30 min, 1 hour, 2 hours, and 4 hours and treated similarly. These samples were stored in a 96-well plate. In some experiments the time points were extended to 8, 24 and 48 hours. Time point samples for the buffer (phosphate buffered saline, PBS, 1× working PBS contains 0.14 M Sodium Chloride, 0.003 M Potassium Chloride, 0.002 M Potassium phosphate, 0.01 M Sodium phosphate) were taken at zero and the last time point of the experiment. Samples were analyzed by electrophoresis through 20% polyacrylamide gels (pre-run at 75 W for 1 hour) in 1×TBE (10×=890 mM Tris, 890 mM Boric acid, 20 mM EDTA, pH 8.0). The gel was transferred to a phosphorimager cassette, covered with an enhancer screen and scanned after overnight exposure.

Polyacrylamide gel analysis indicated that the ocular environment contains fewer nucleases than human serum. Testing the unmodified form of the VEGF siRNA AL-DP-4014 for stability in rat eye extract revealed only the presence of exonuclease activity. In human serum, experiments with AL-DP-4127 and -4140 (Tables 4 and 5) indicated that terminally modified phosphorothioate modifications protected against exonucleolytic degradation but not against endonucleolytic activity. These results were consistent with experiments performed in rat whole eye extracts. The terminally modified phosphorothioate derivatives AL-DP-4127 and -4140 were stabilized against exonuclease activity as compared to the unmodified AL-DP-4014 siRNA and the unmodified Cand5 siRNA (Reich et al. (supra)). However, the -4127 and -4140 siRNAs were still subject to endonucleolytic degradation.

Modifications to the lead compound AL-DP-4094 stabilized the siRNA against exonucleolytic and endonucleolytic degradation. The phosphorothioate-modified siRNA AL-DP-4198 was degraded to a similar extent as the unmodified 4094 compound, but the addition of O-methyl modifications, as in AL-DP-4180 and AL-DP-4220, stabilized the siRNAs in rat whole eye extracts.

Notably, the siRNAs were generally more stable in rat retina lysates than in the rat whole eye extracts described above. Neither the unmodified AL-DP-4094, nor the modified AL-DP-4198, -4180, or -4220 siRNAs were degraded in the retina lysates.

Example 7

Endonuclease-Sensitive Sites were Mapped on AL-DP-4094 siRNA

Figure 11:
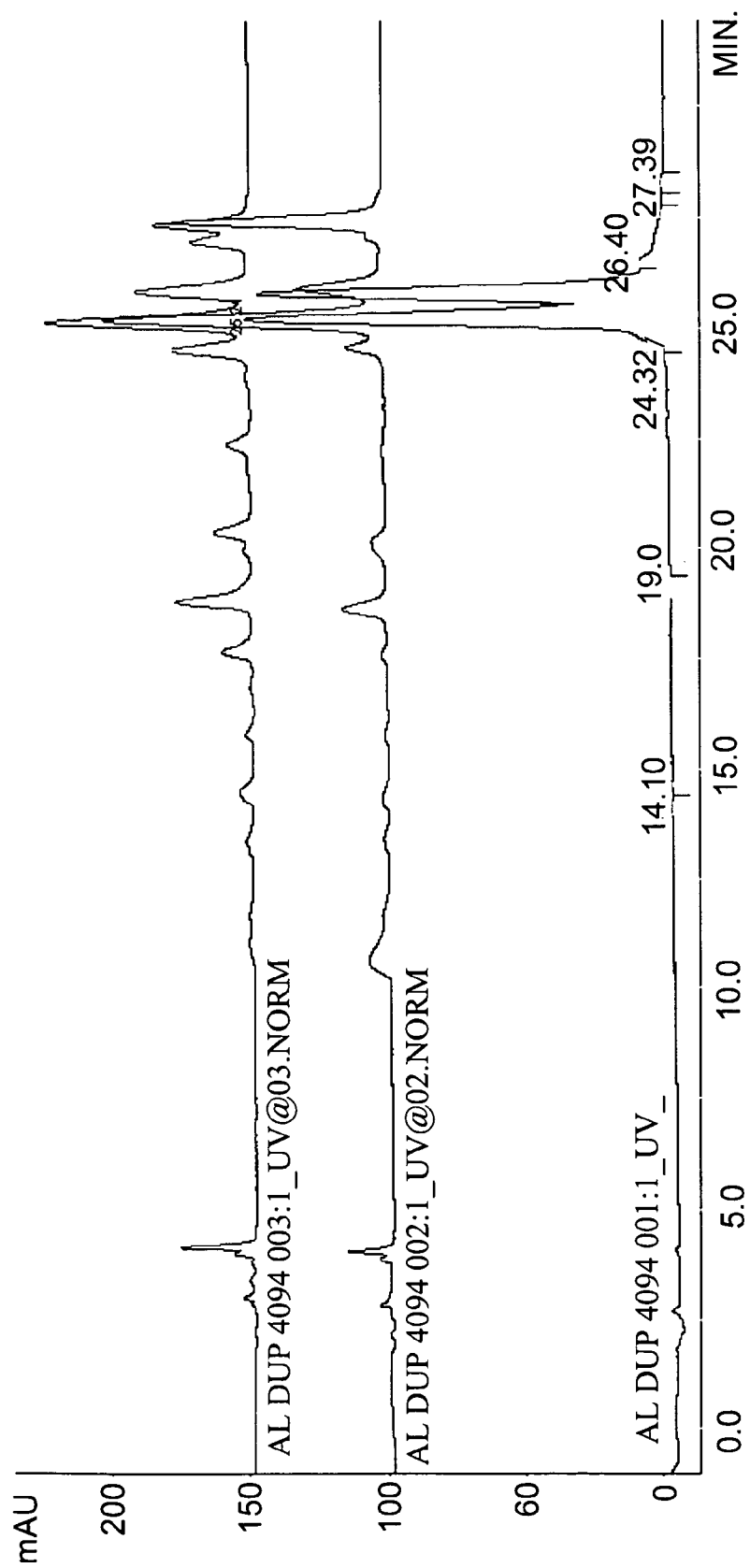
FIG. 11 is an RP-HPLC scan of AL-DP-4094 siRNA following incubation in human serum.
Figure 13:
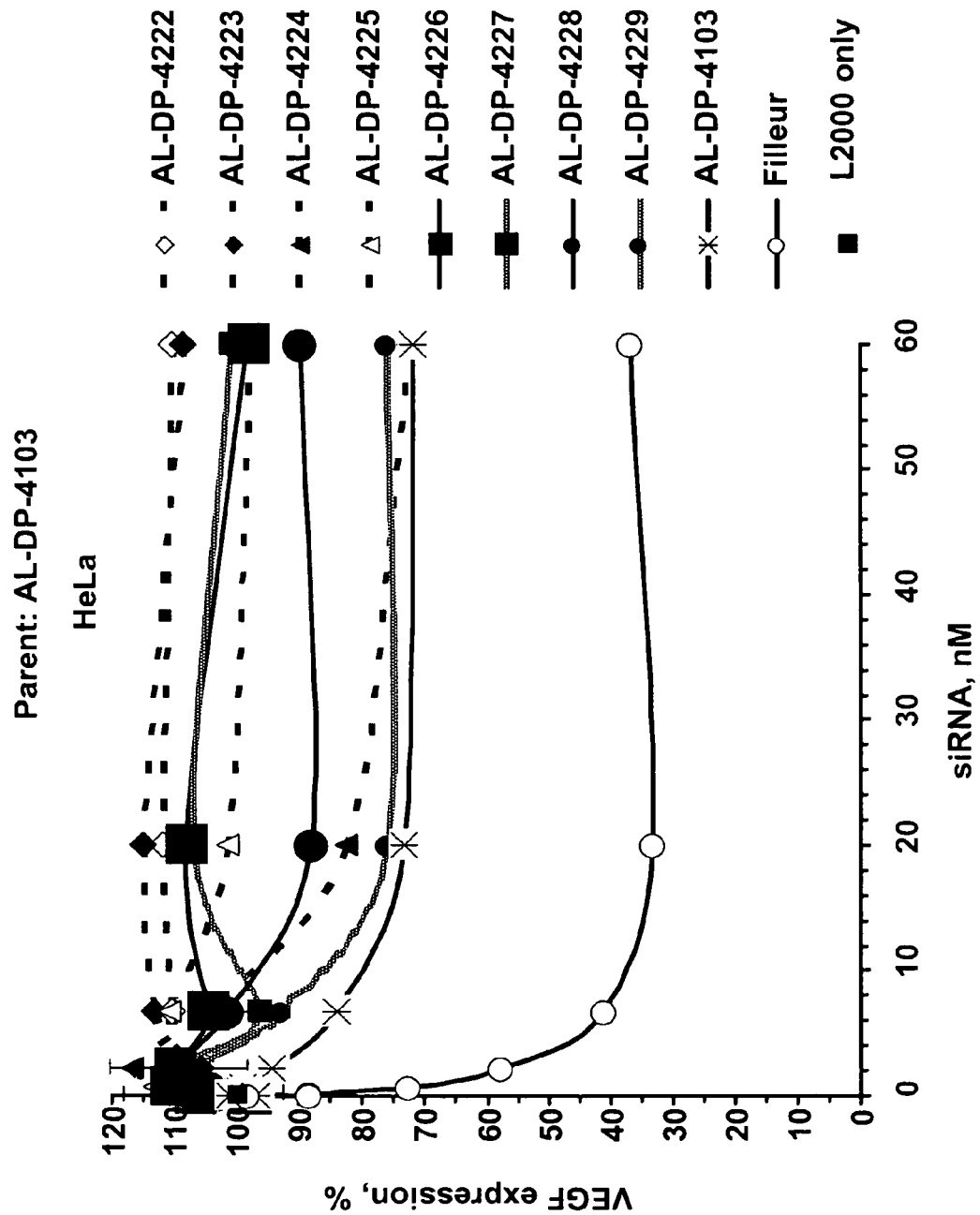
FIGS. 13-29 are graphs of silencing activity of 2'-O-methyl and/or 2'-fluoro modified siRNAs in vitro in HeLa cells (Table 6).
Figure 14:
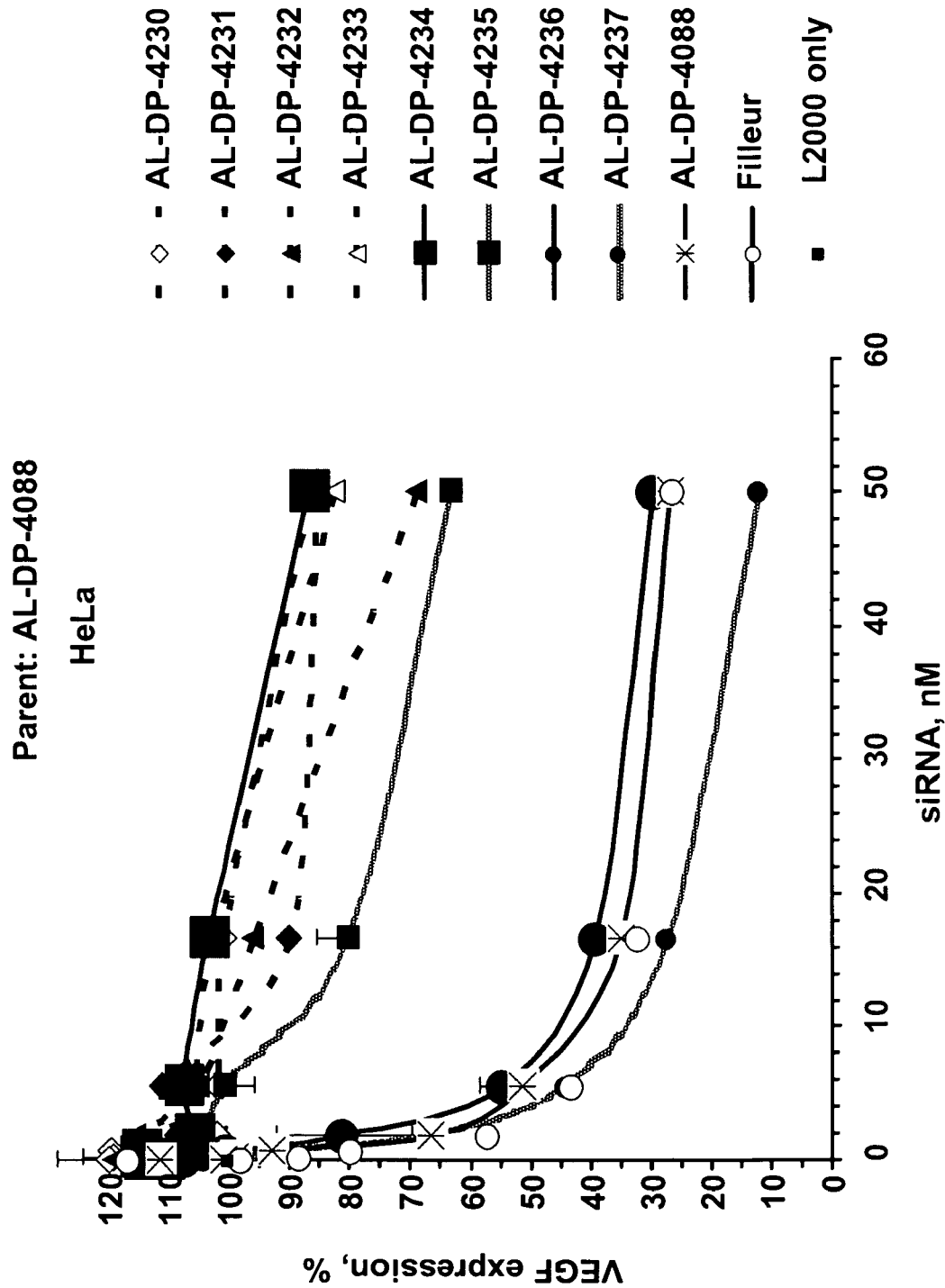
Figure 15:
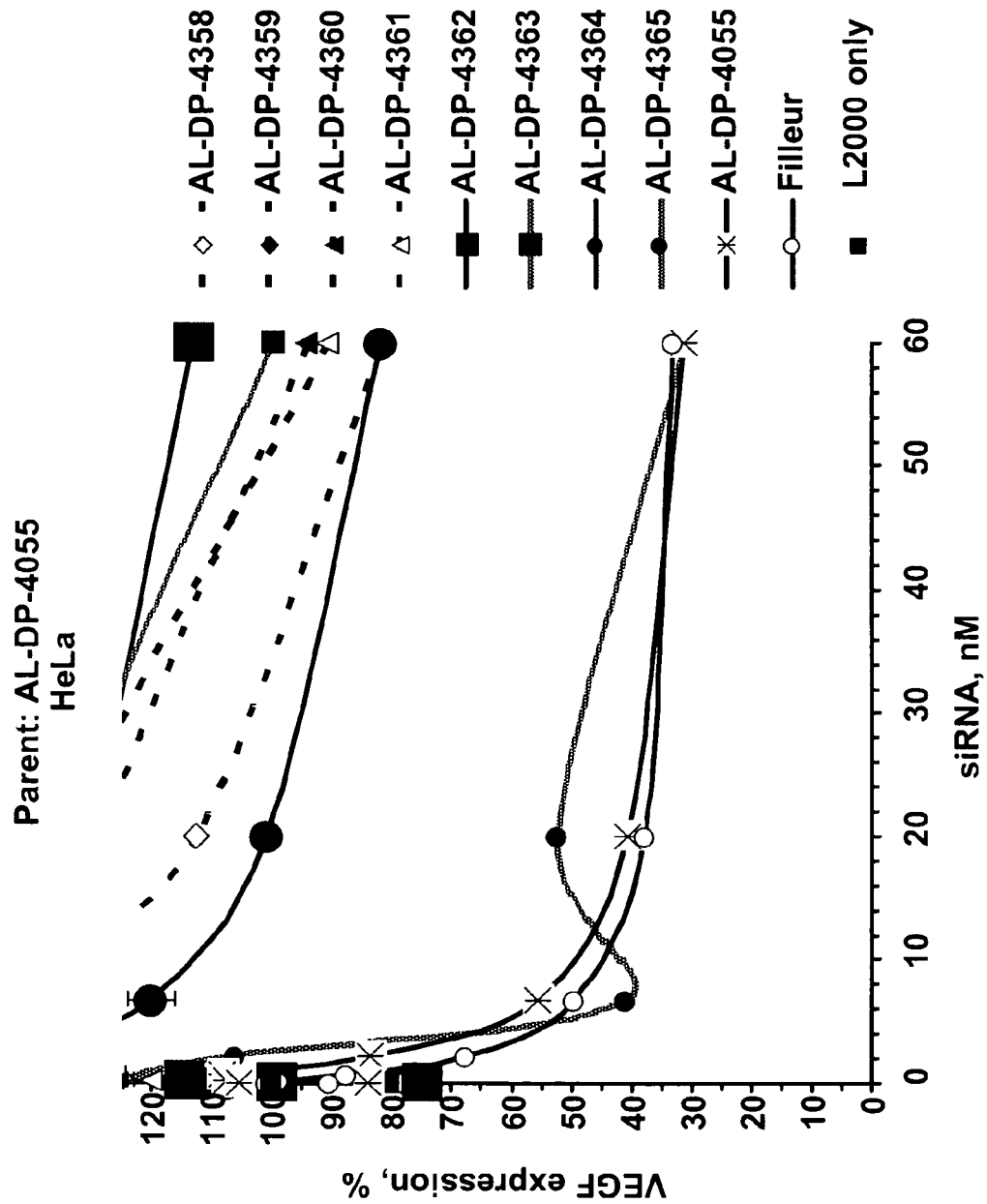
Figure 16:
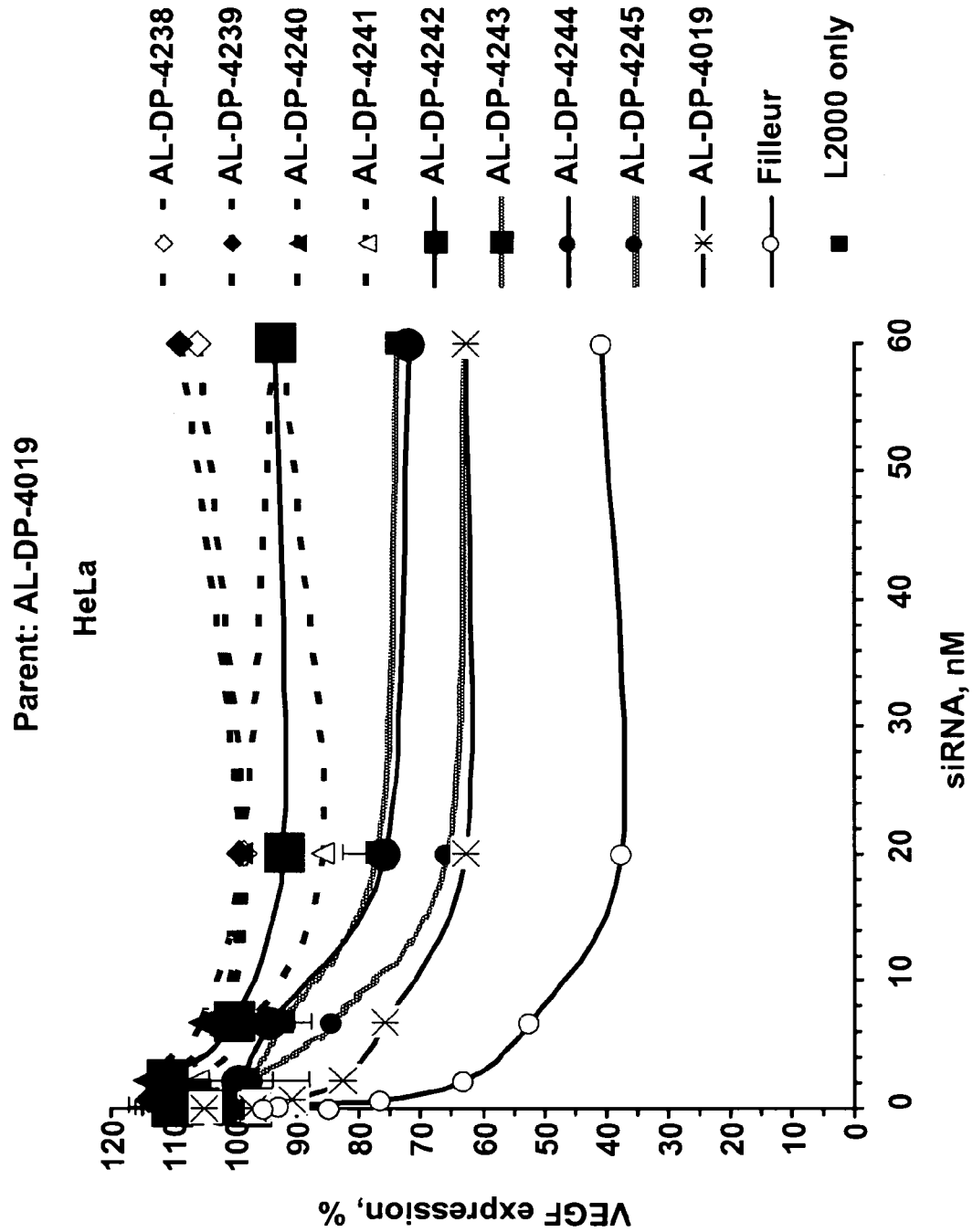
Figure 17:
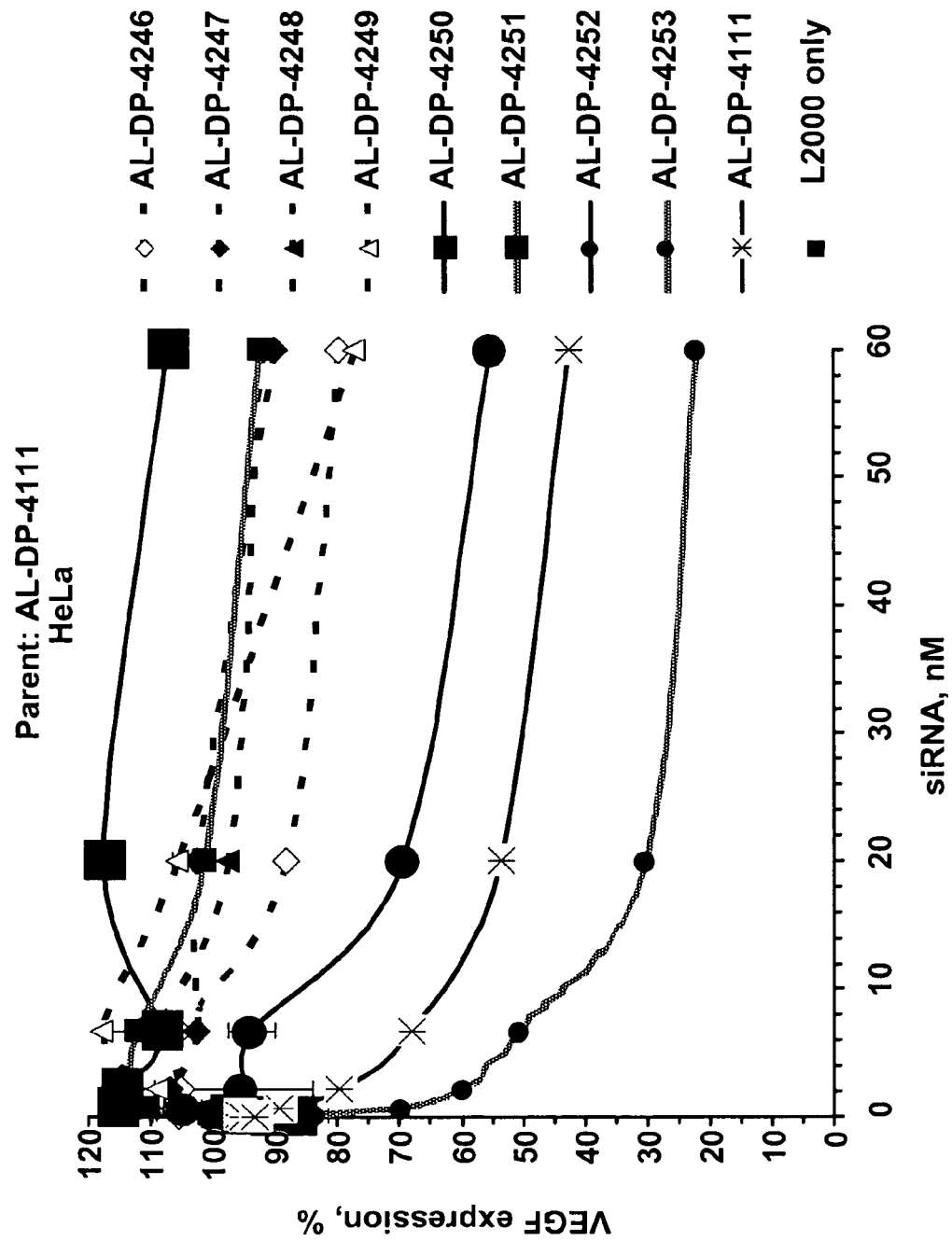
Figure 18:
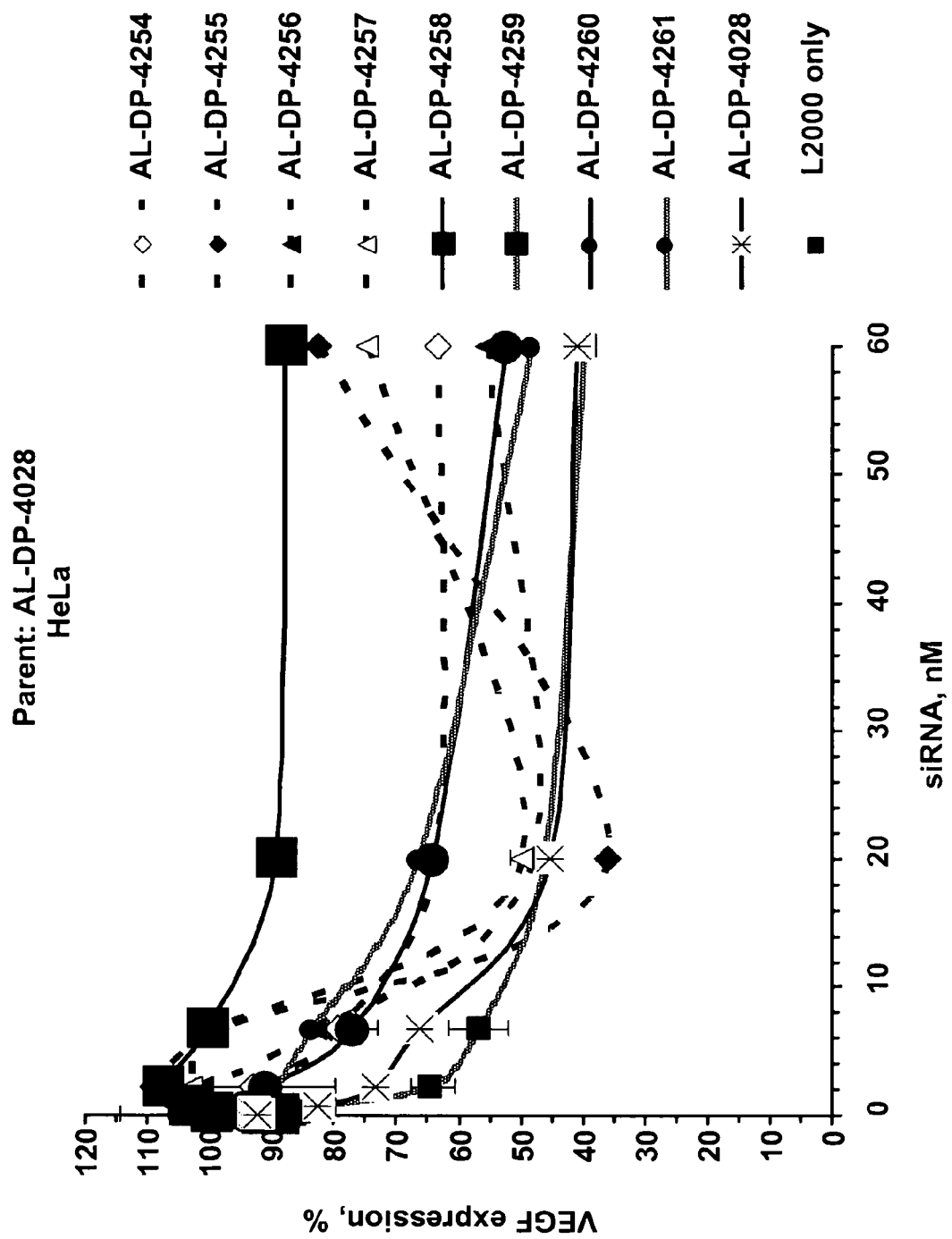
Figure 19:
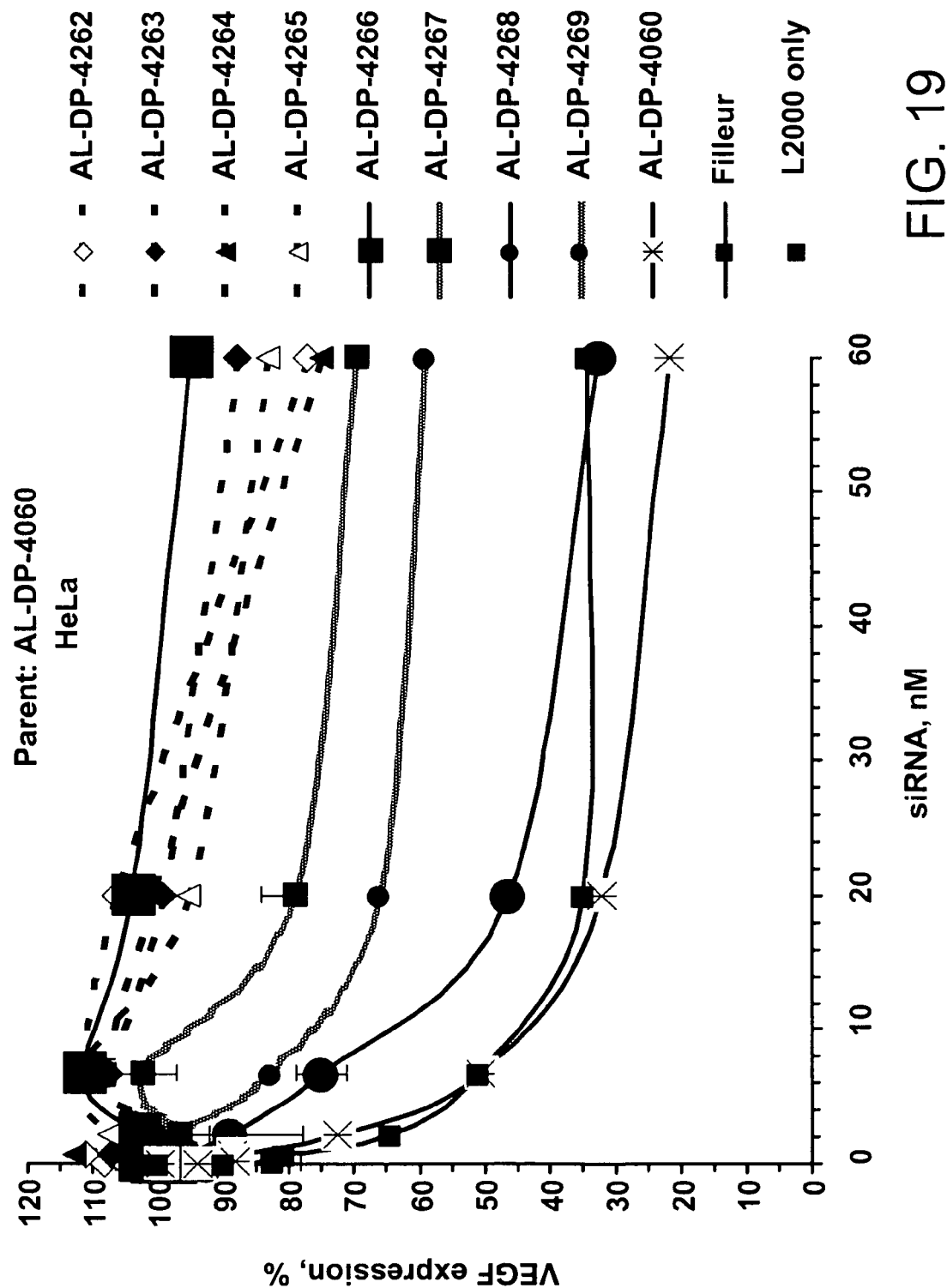
Figure 20:
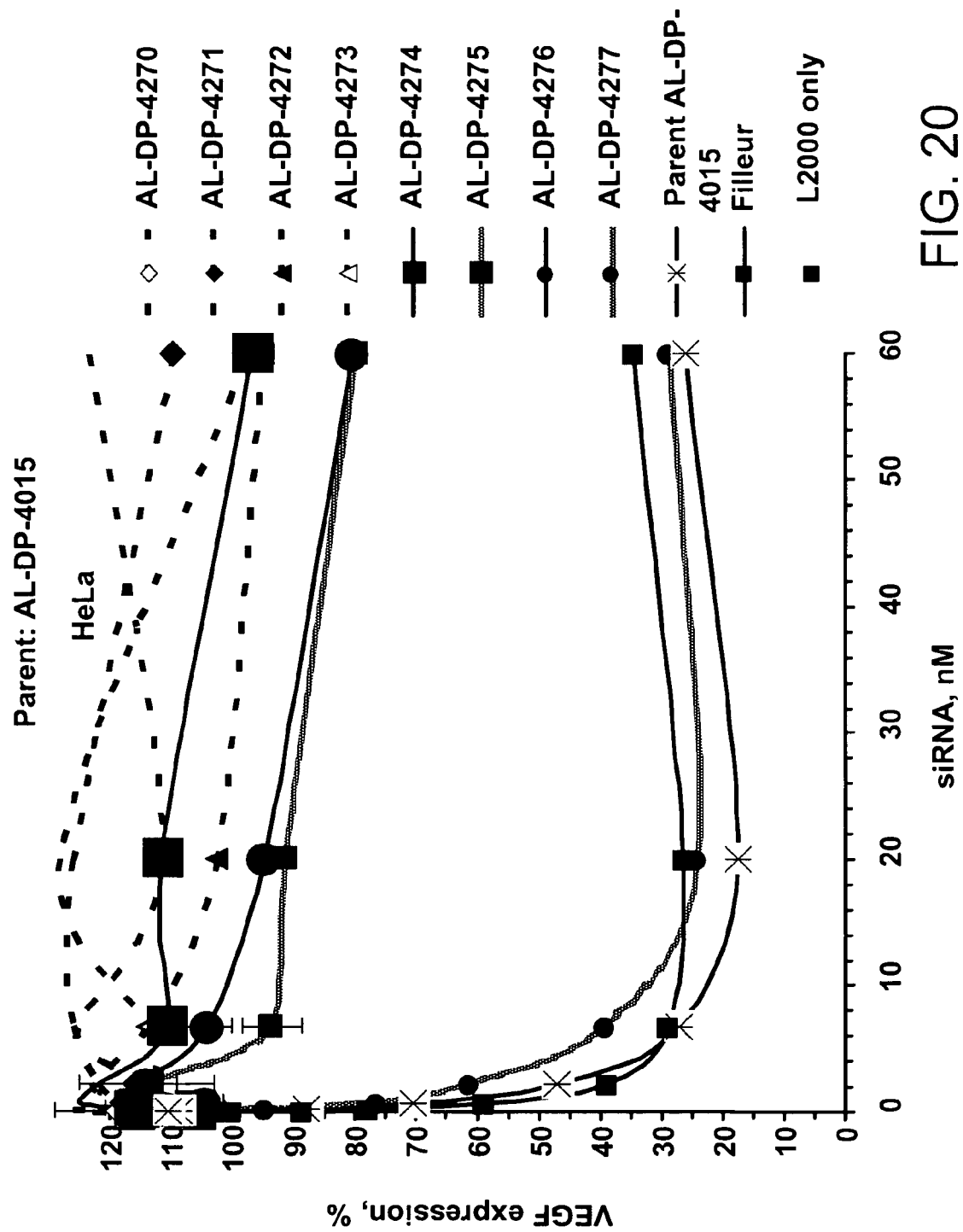
Figure 21:
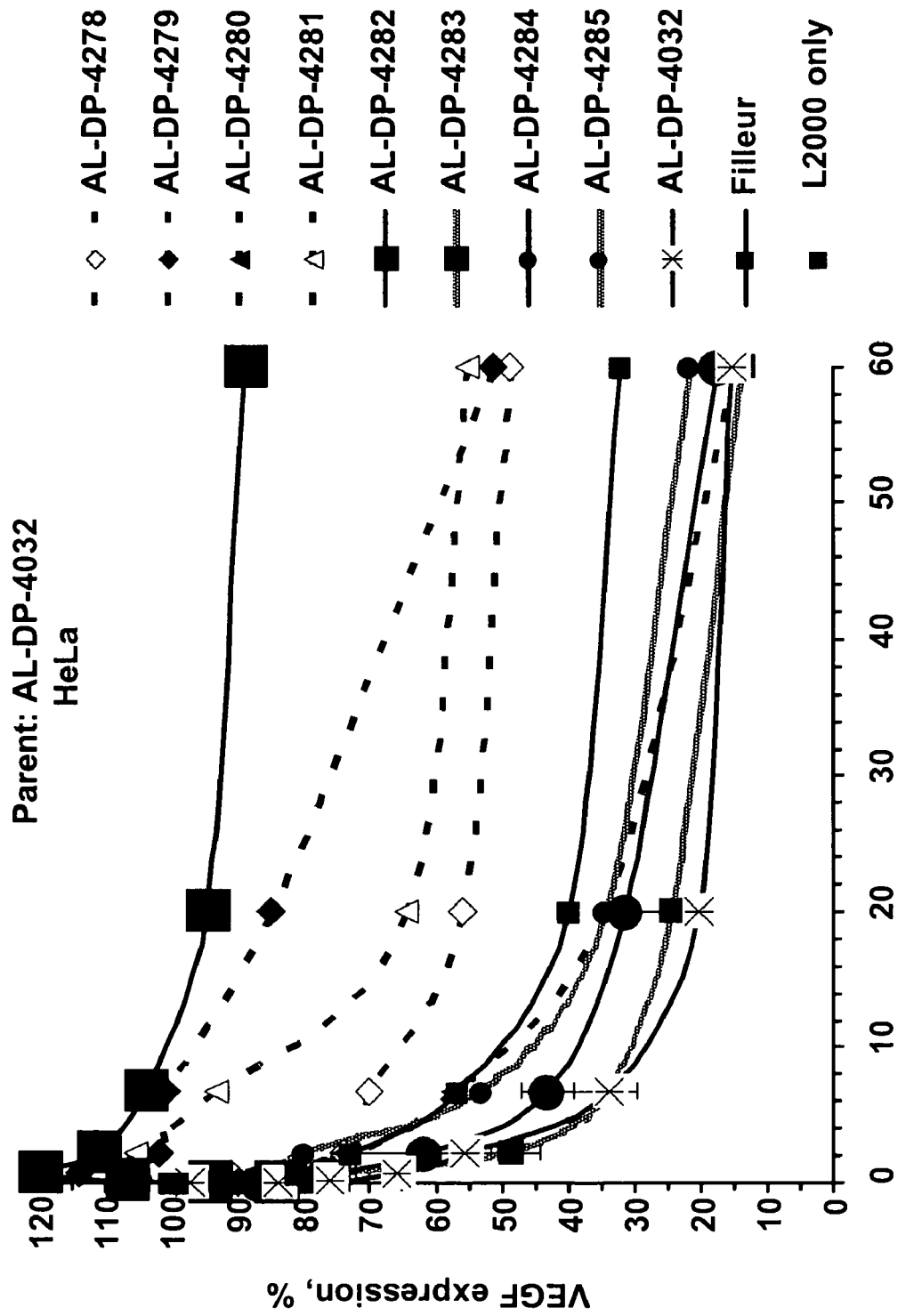
Figure 22:
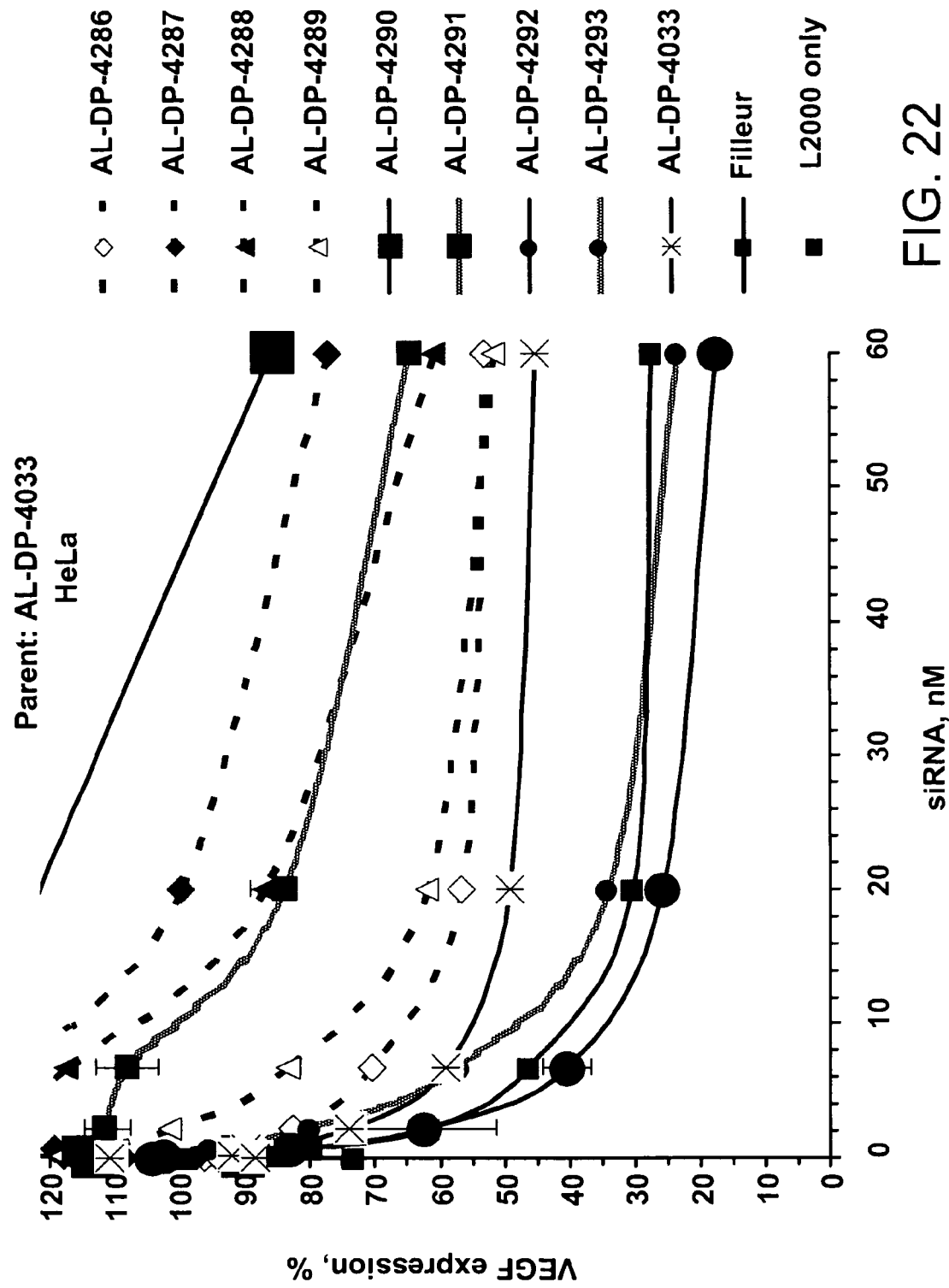
Figure 23:
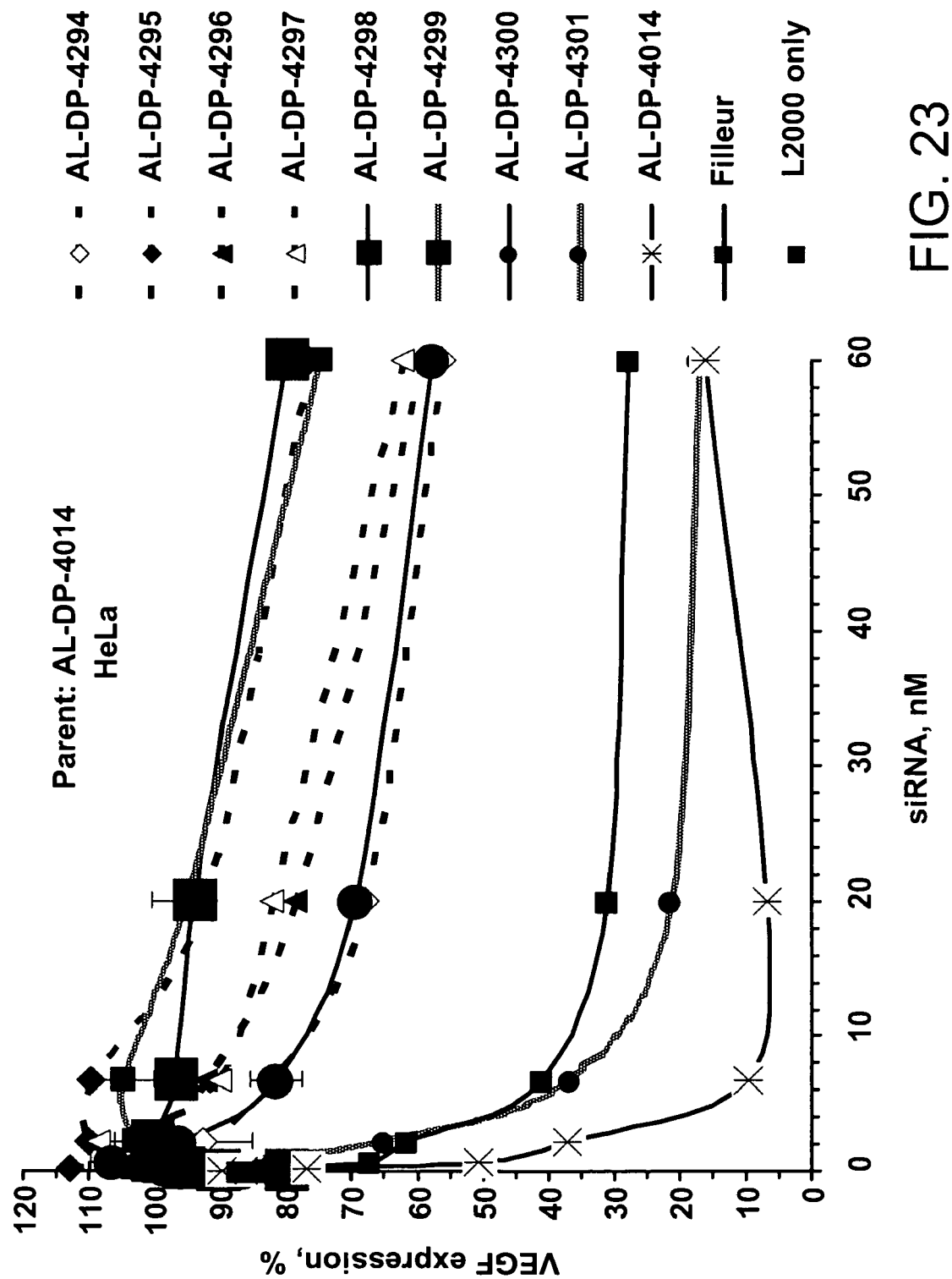
Figure 24:
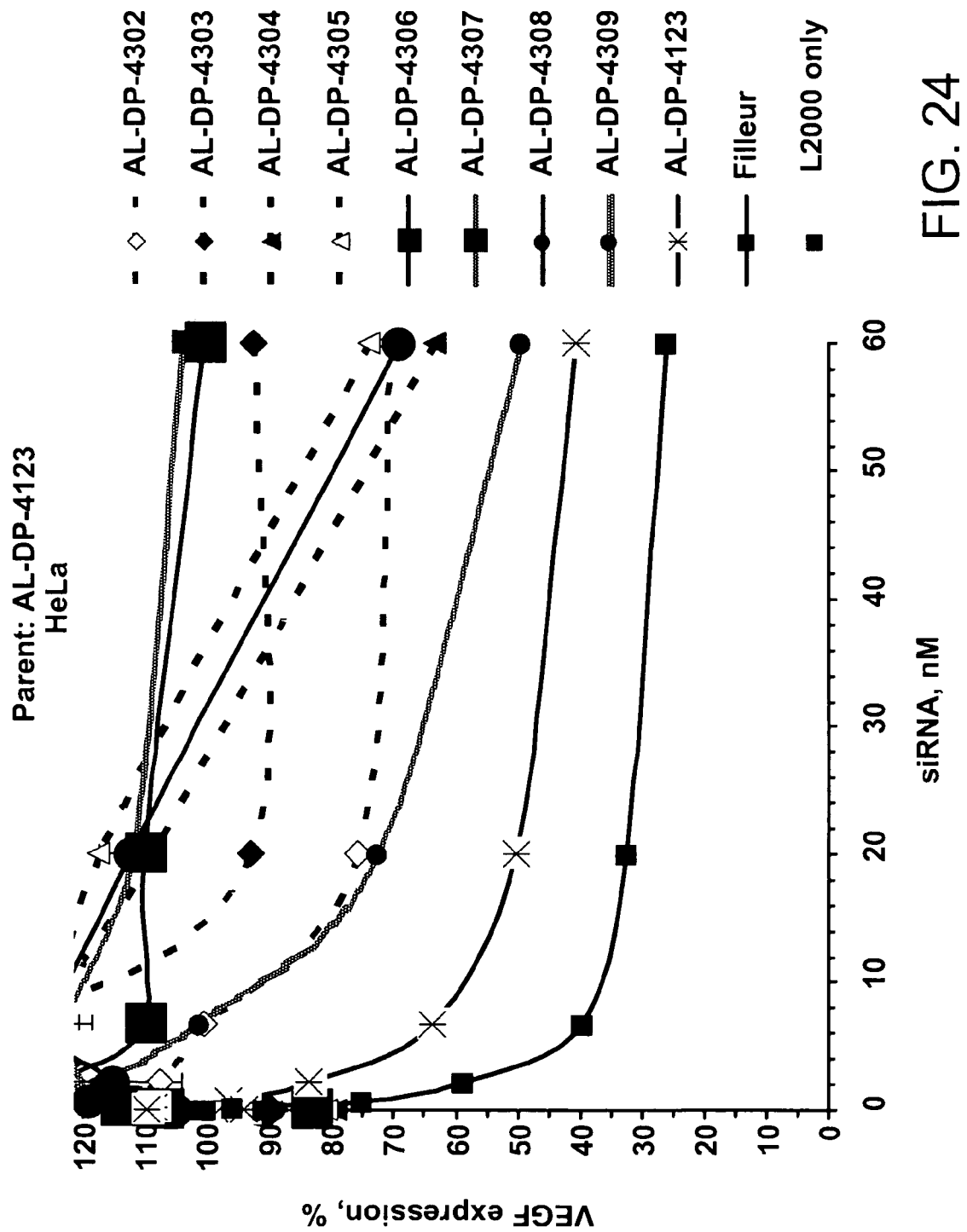
Figure 25:
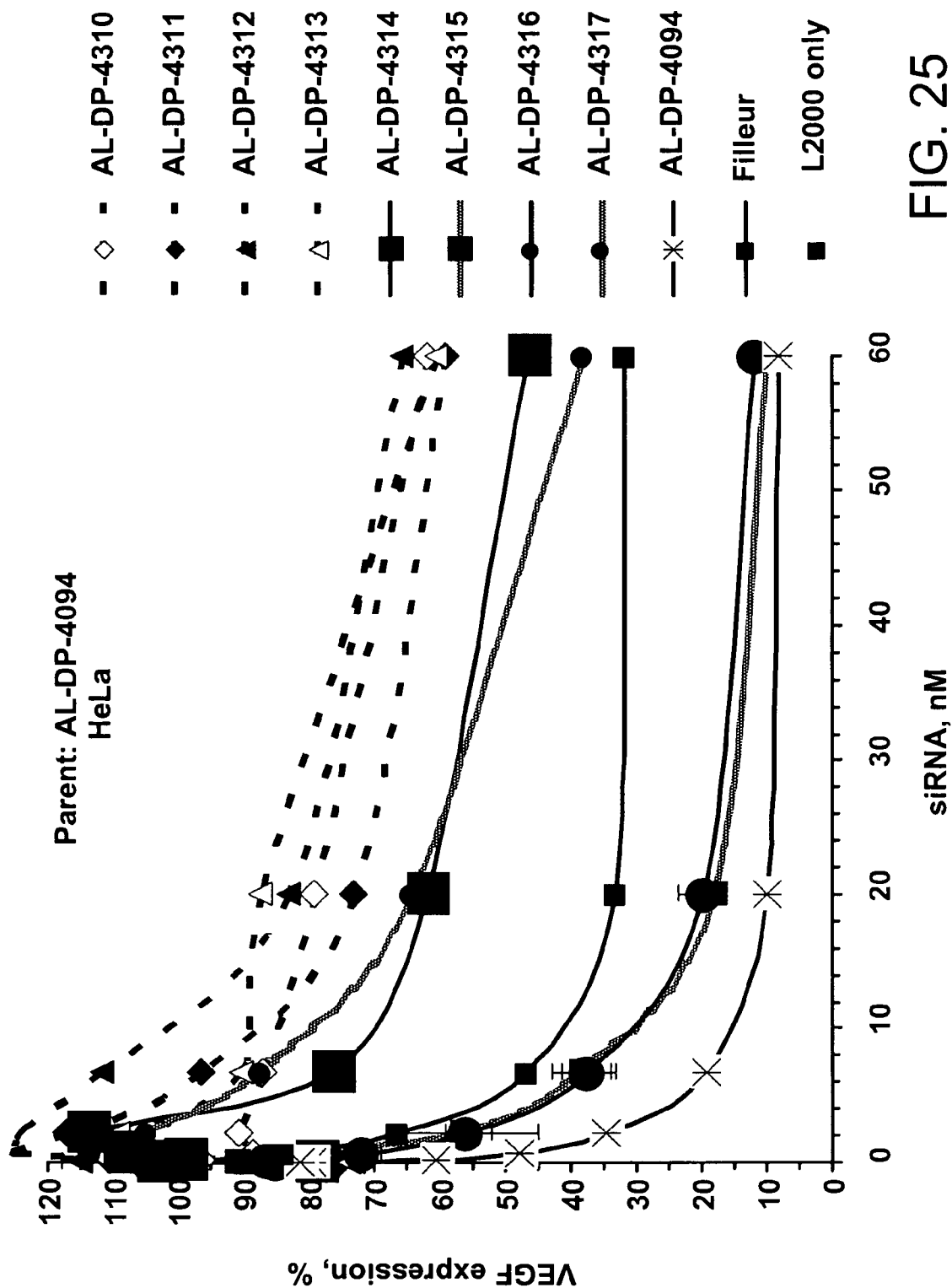
Figure 26:
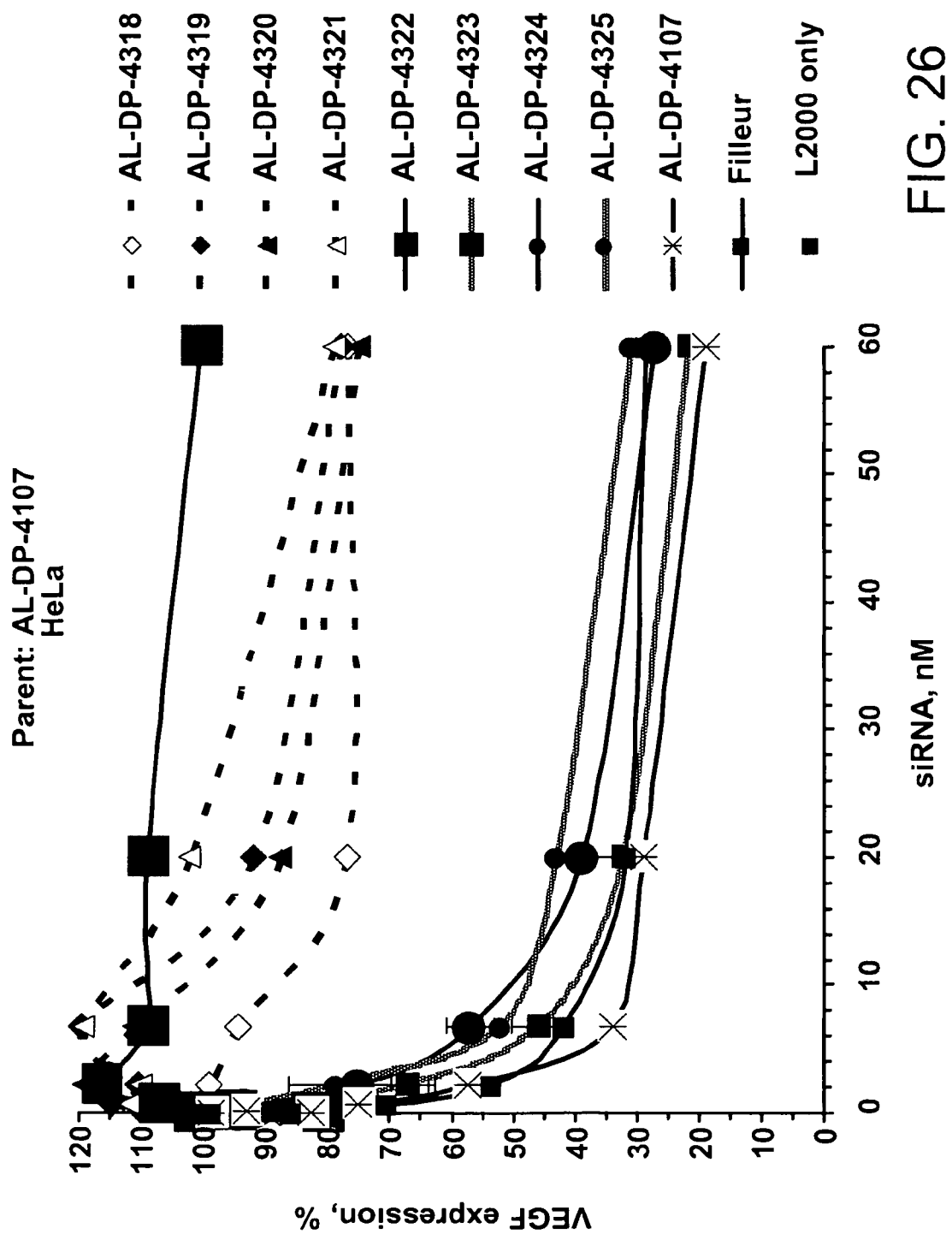
Figure 27:
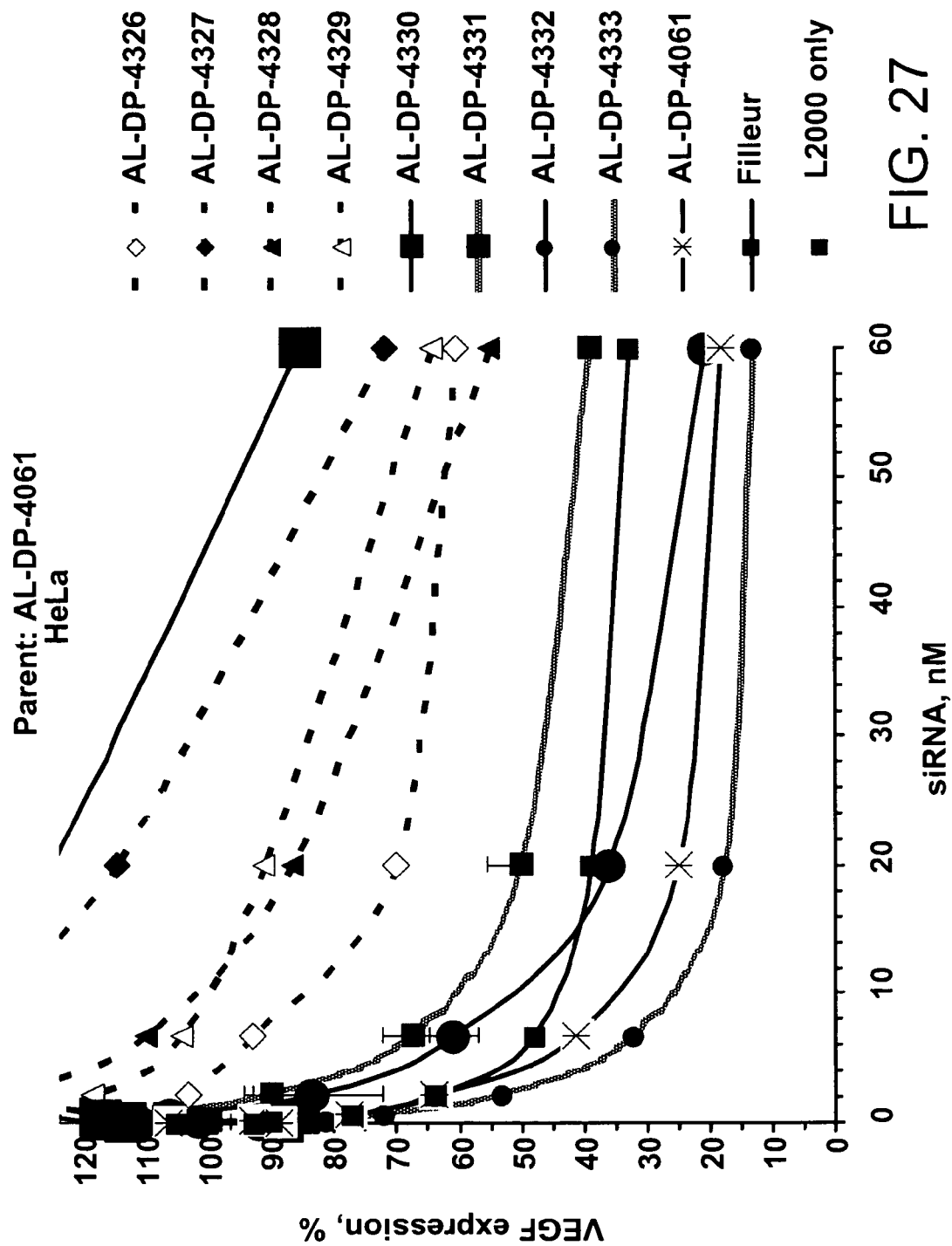
Figure 28:
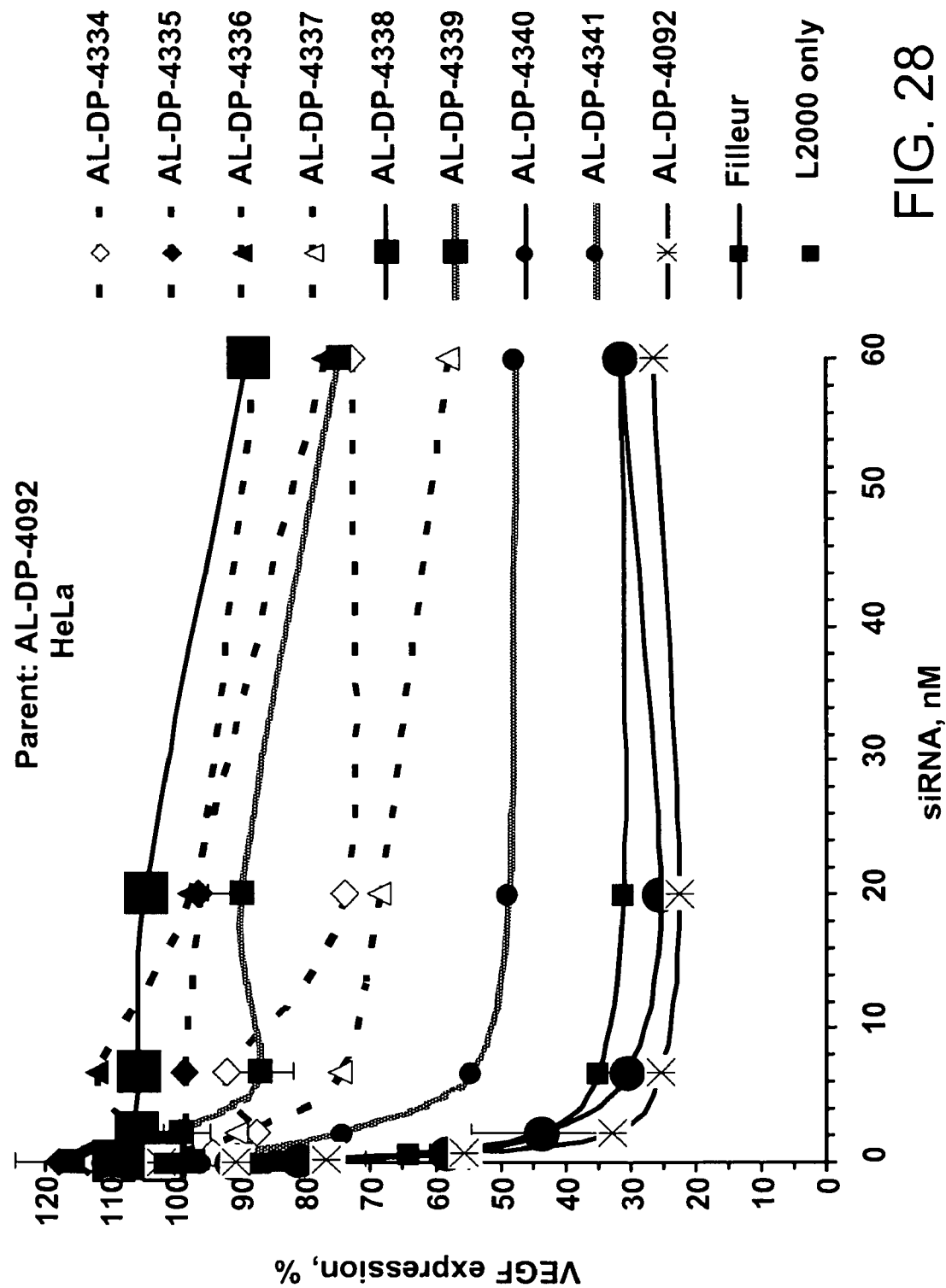
Figure 29:
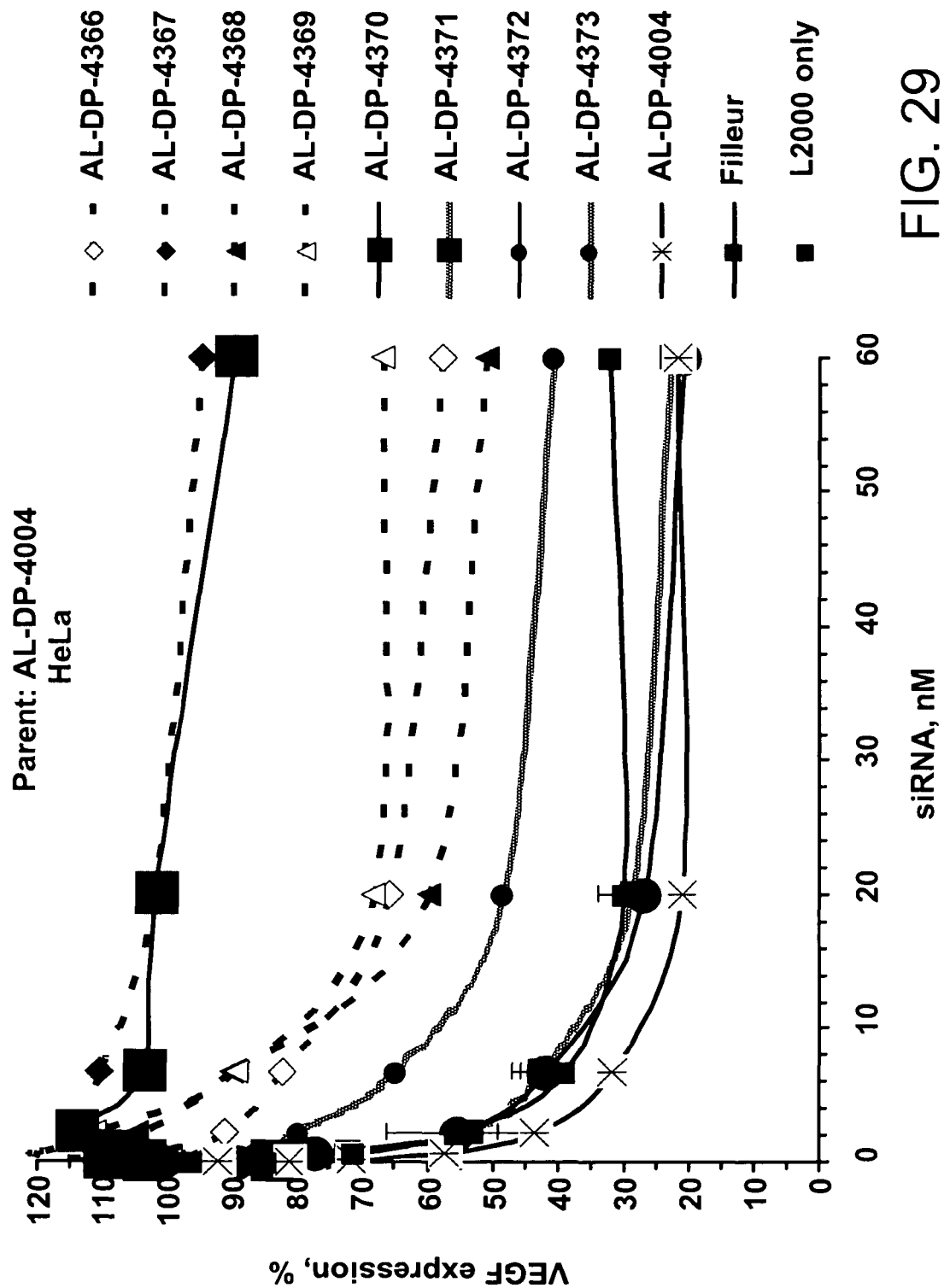
Figure 30A:
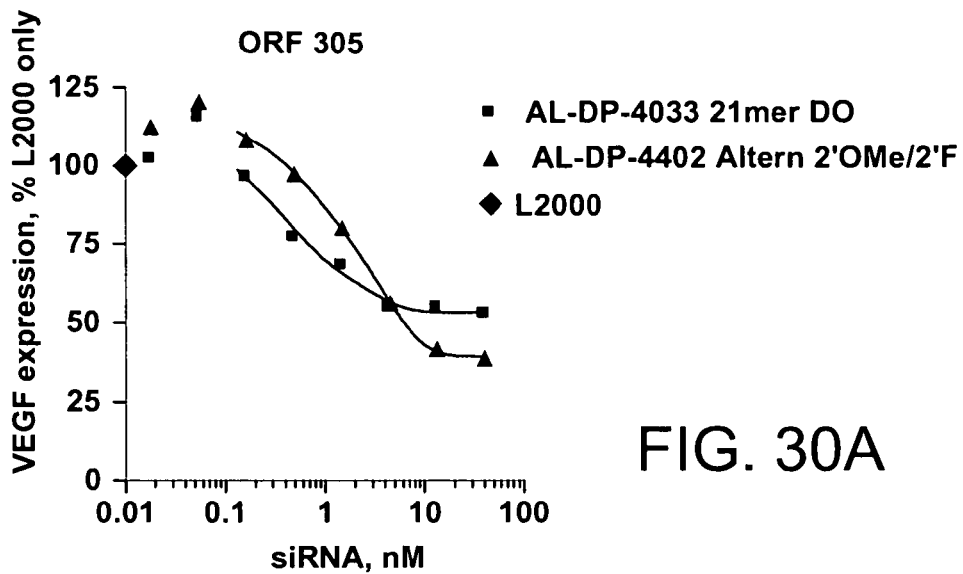
FIG. 30 are graphs of silencing activity of alternating 2'-O-methyl and 2'-fluoro modified siRNAs in vitro in HeLa cells (Table 7).
Figure 30B:
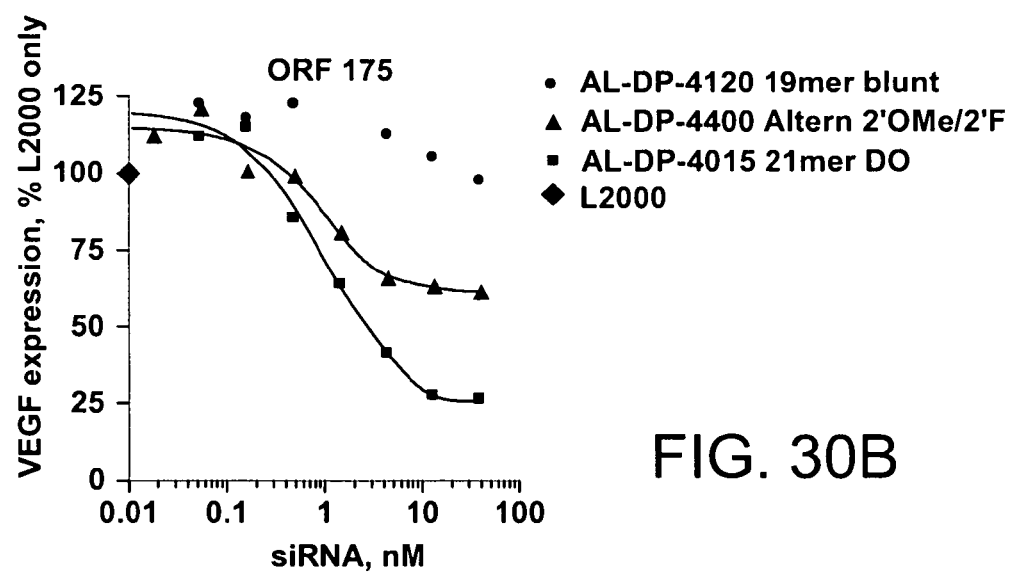
Figure 30C:
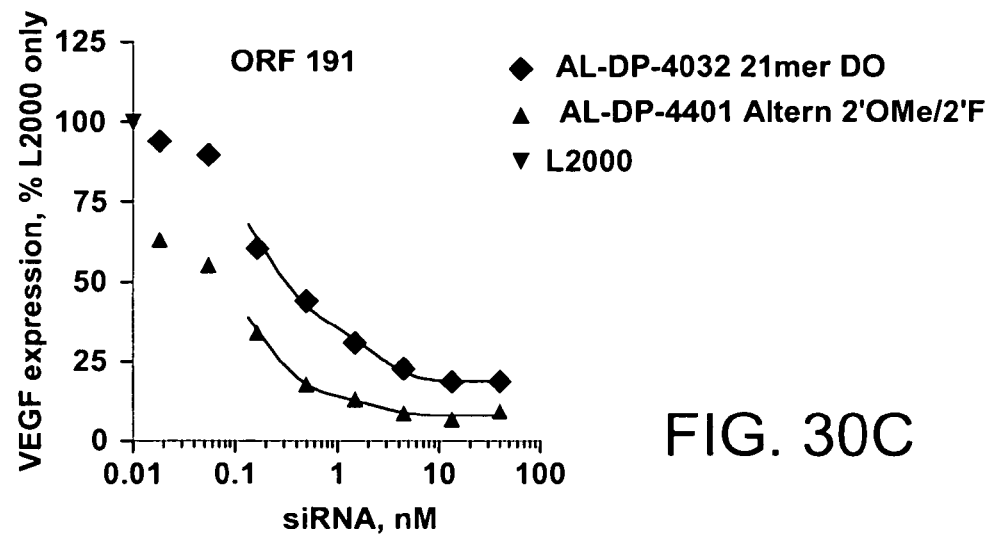
Figure 30D:
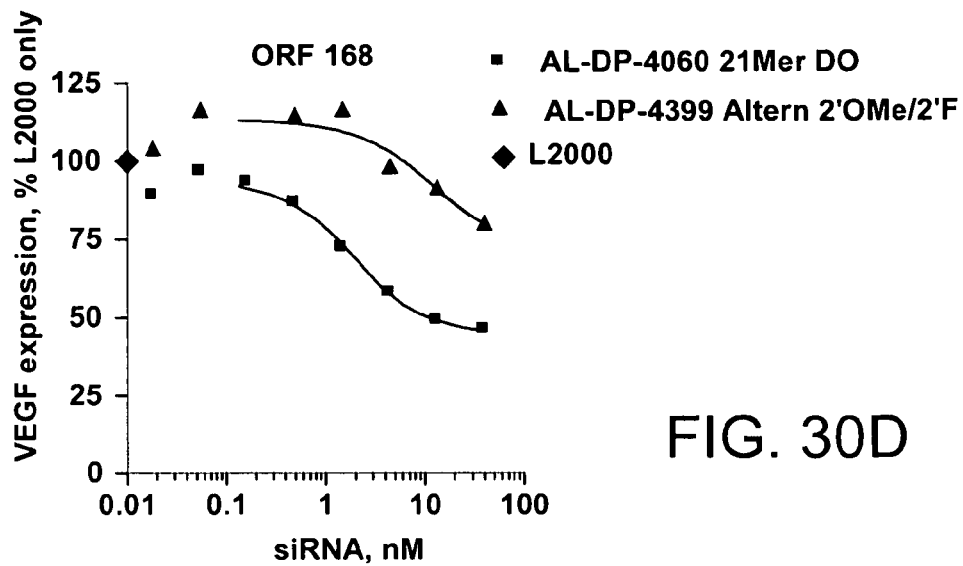
Figure 30E:
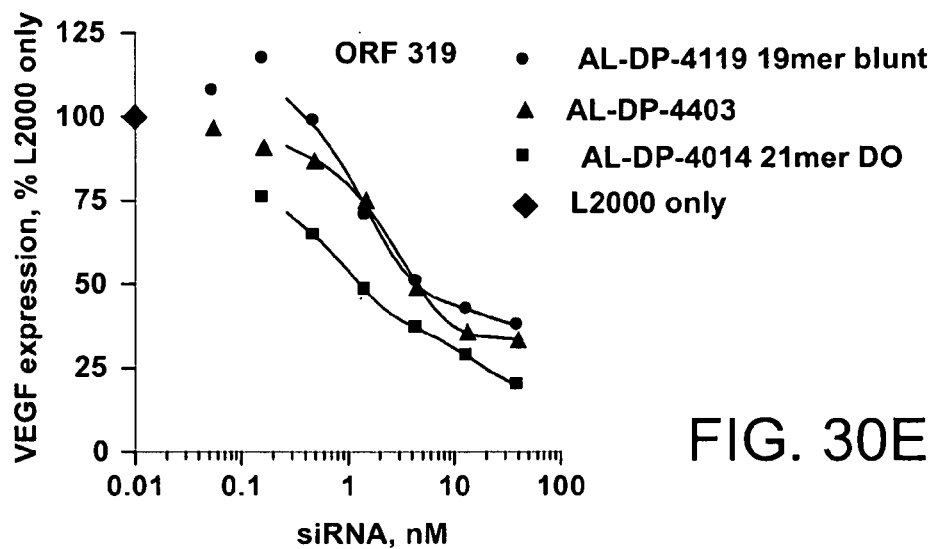
Figure 30F:
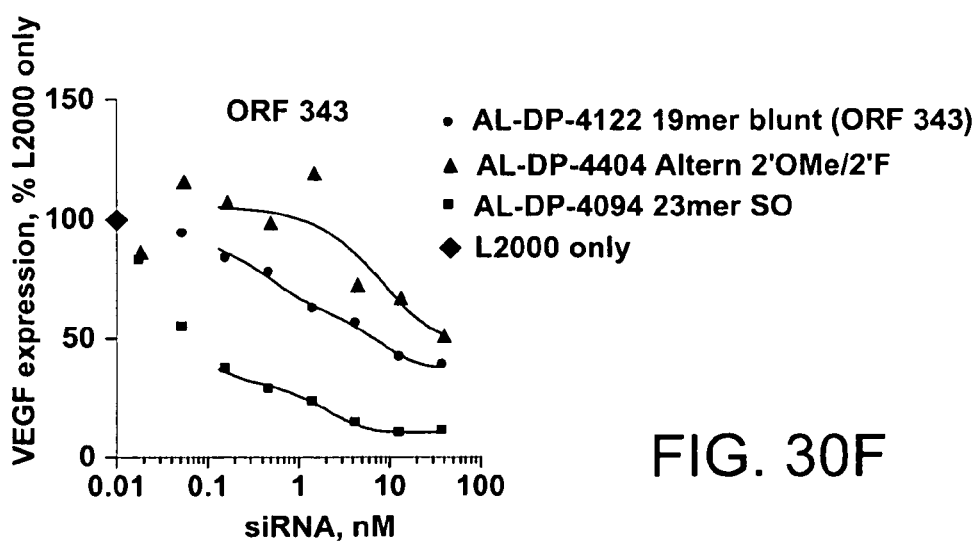
Figure 30G:
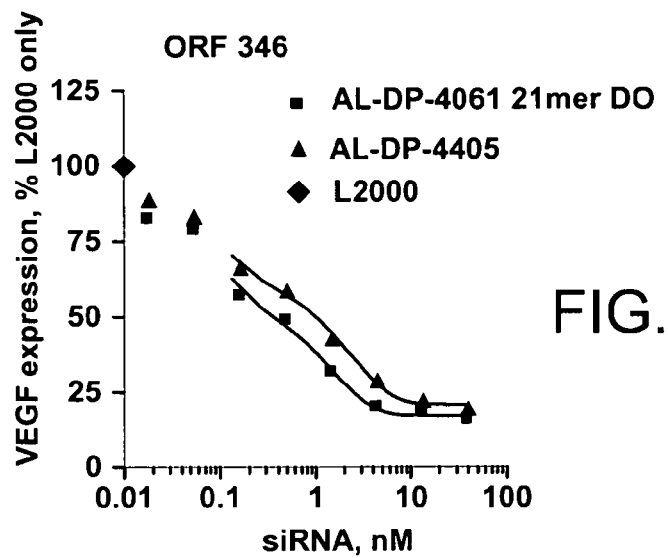
Figure 30H:
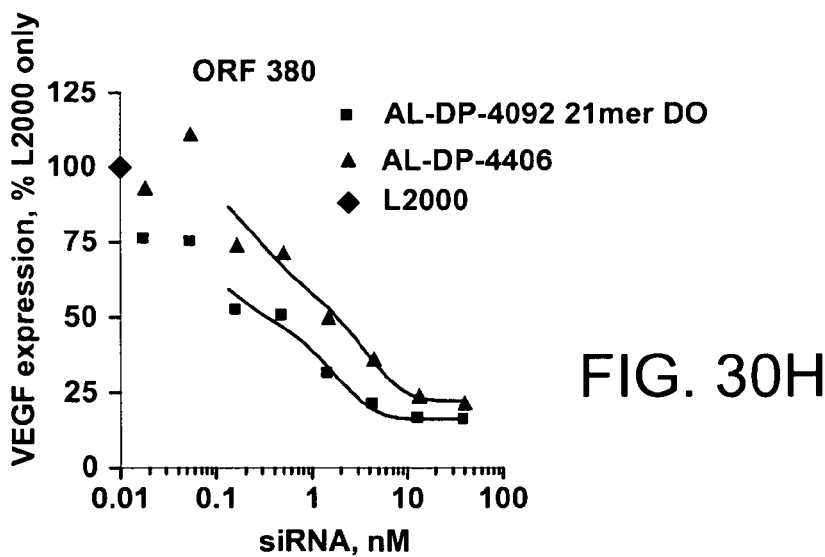
Figure 30I:
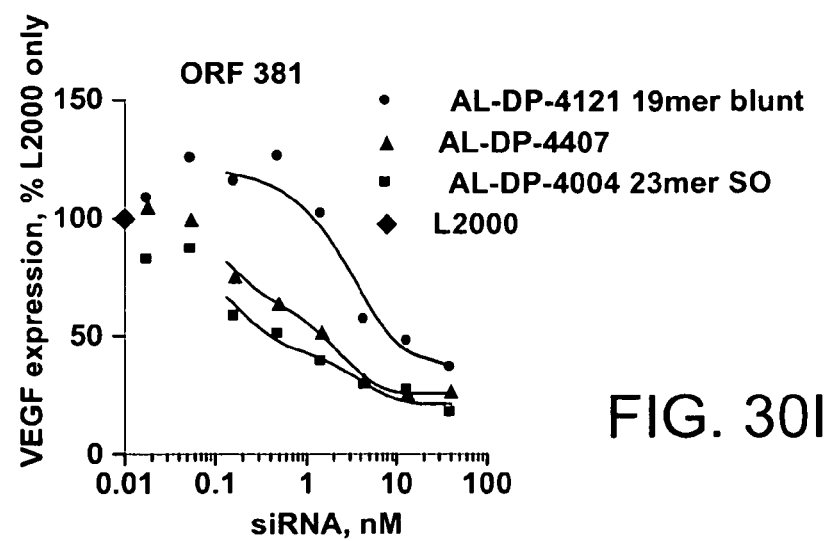
Figure 31:
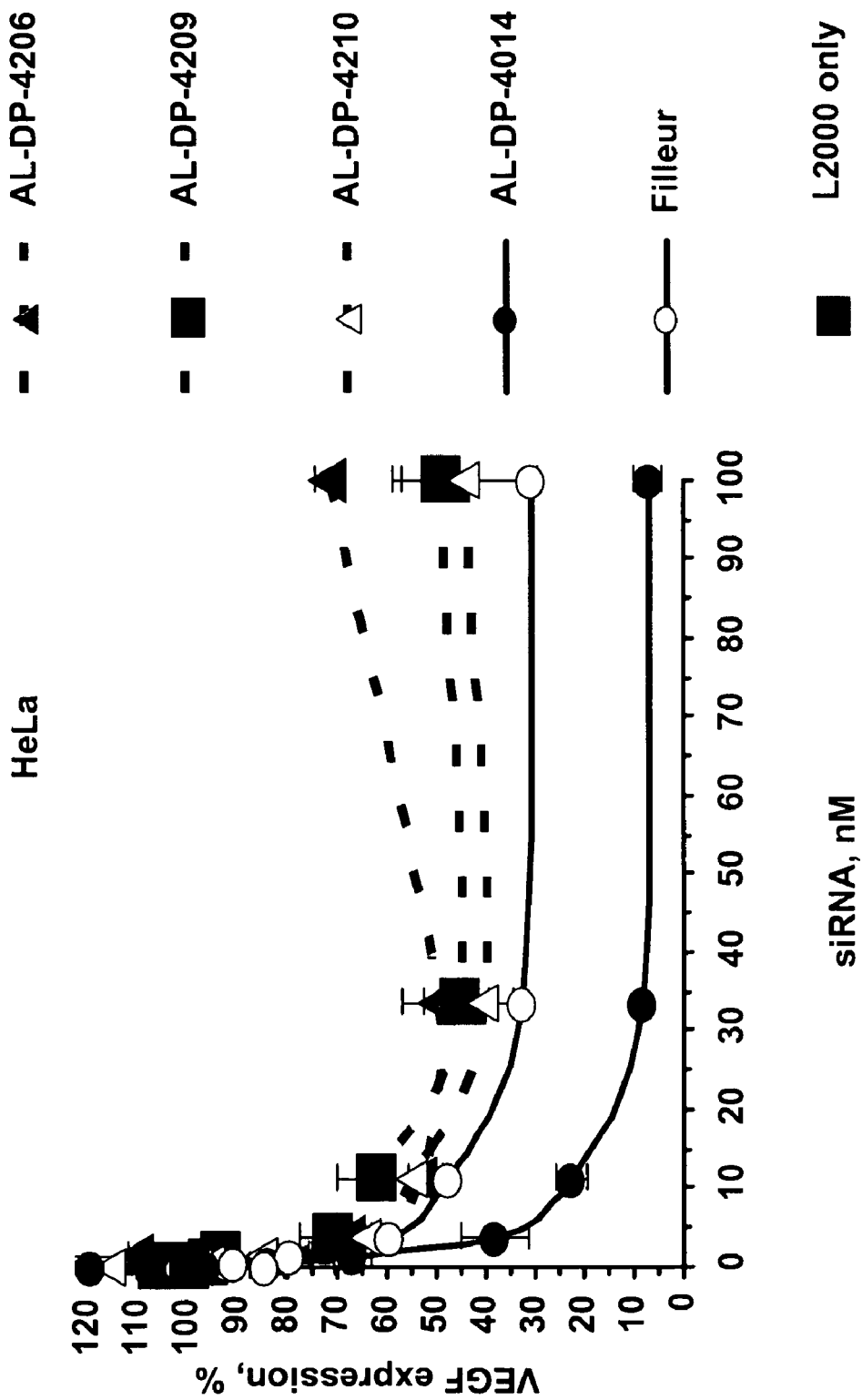
FIGS. 31-33 are graphs of silencing activity of cholesterol and colonic conjugated siRNAs in vitro in HeLa cells (Table 8).
Figure 32:
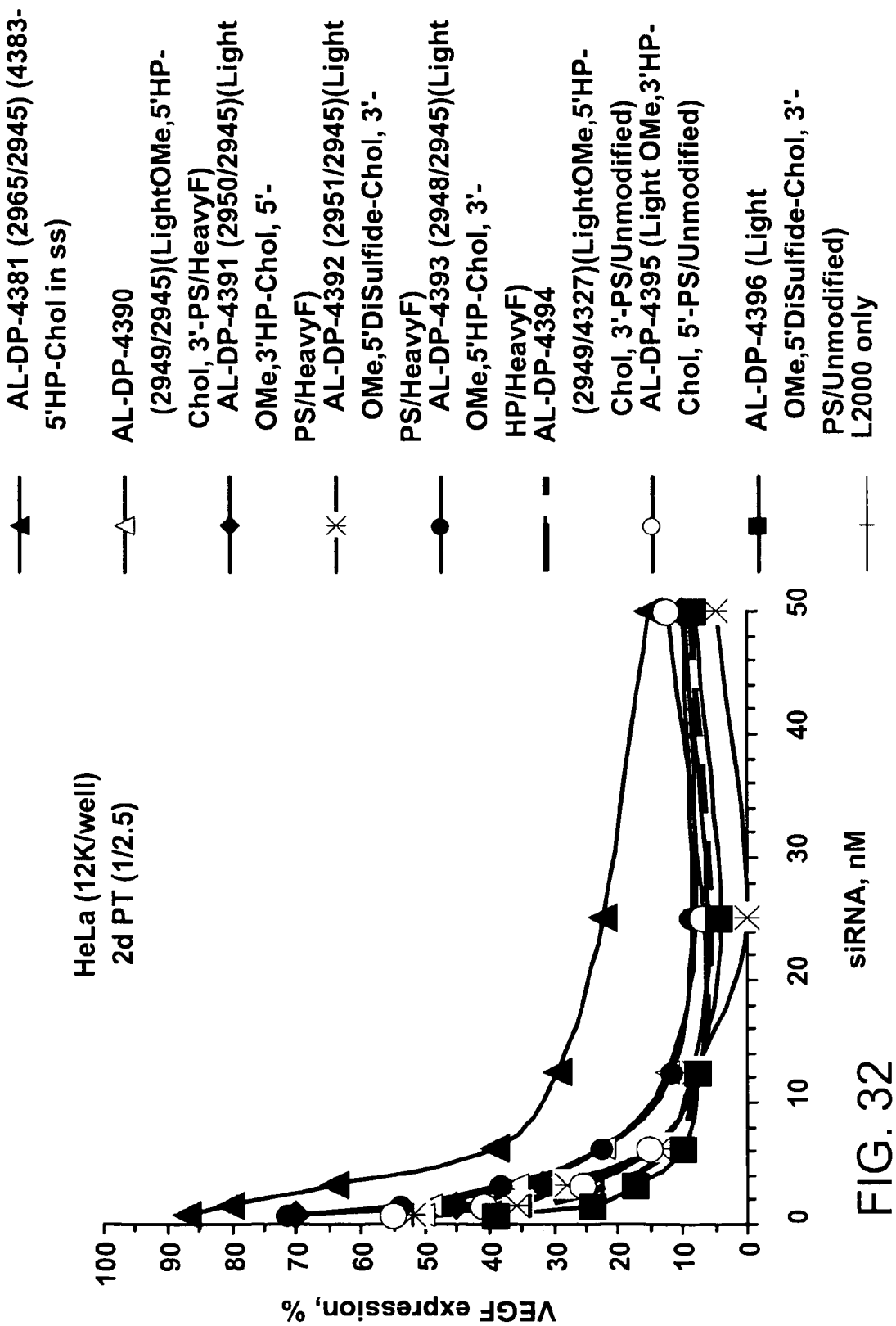
Figure 33:
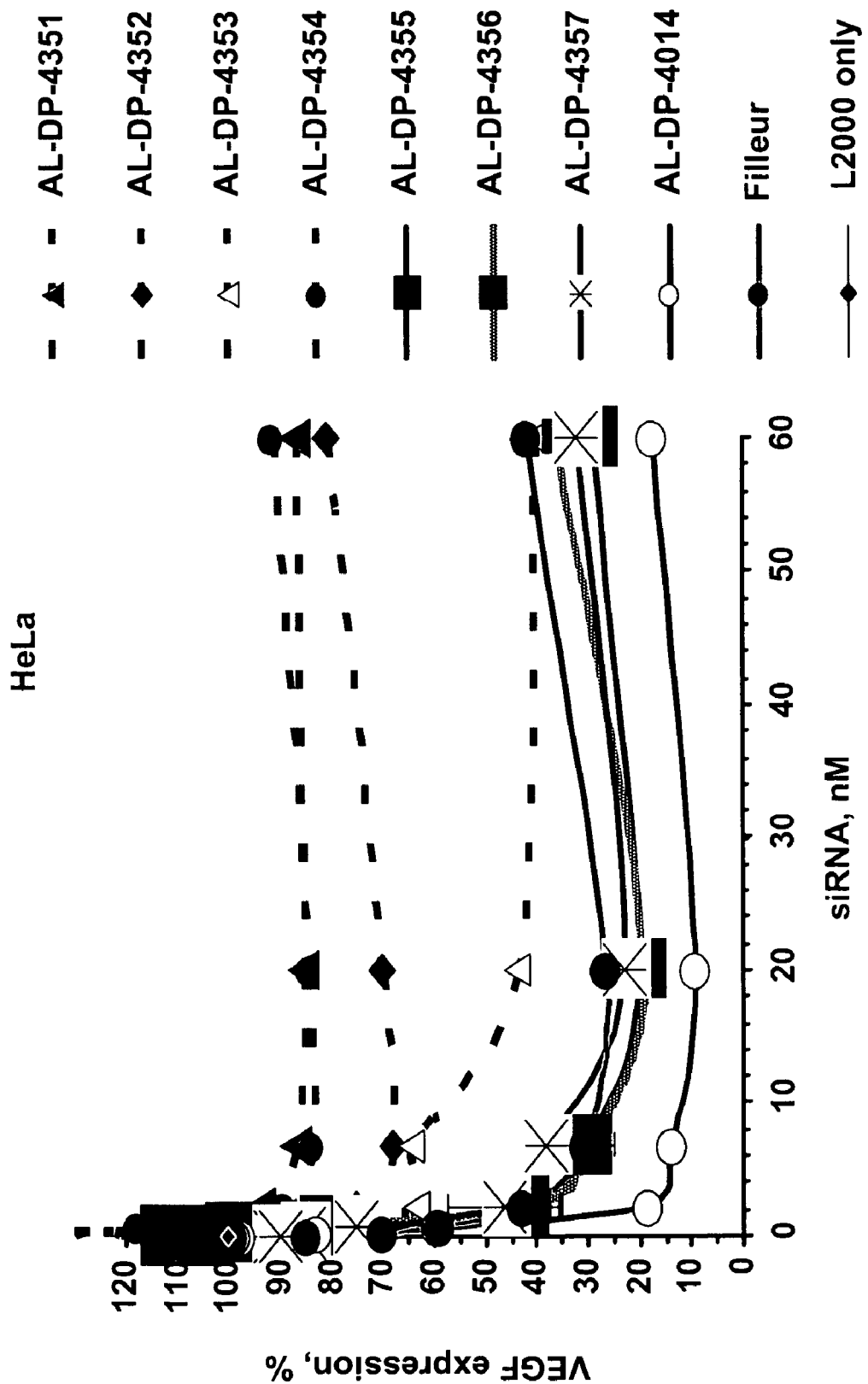
Figure 34:
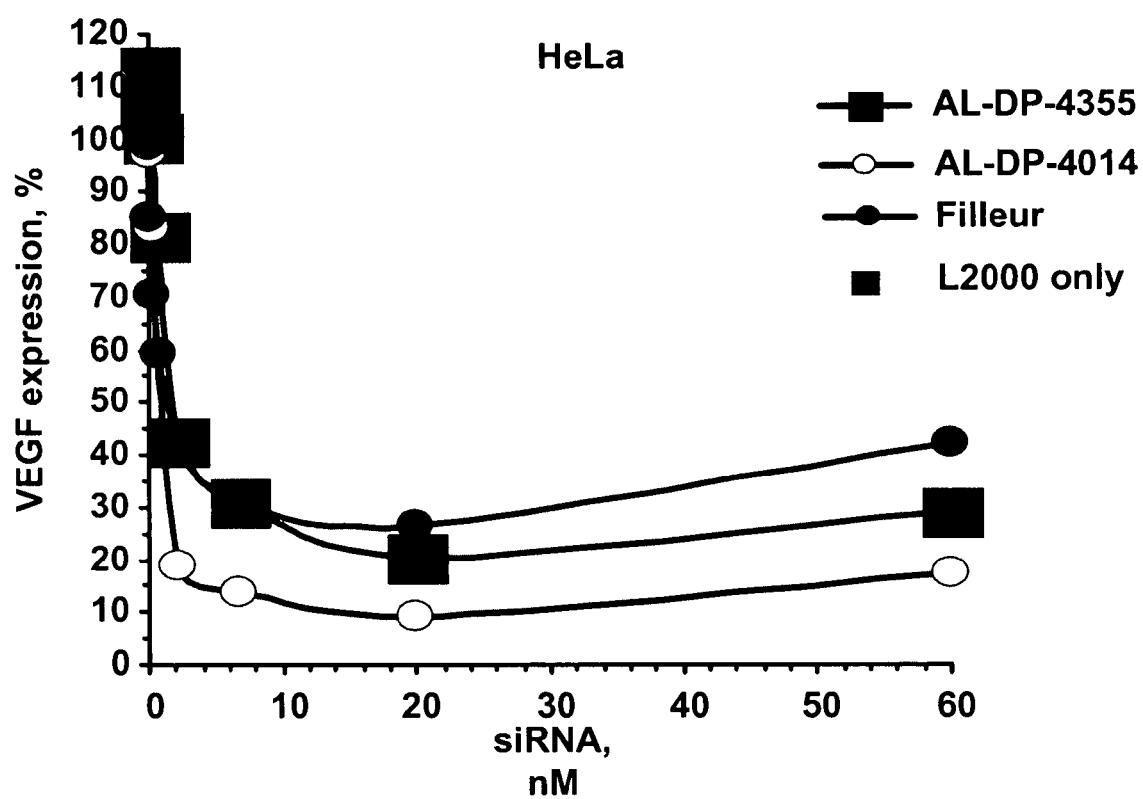
FIG. 34 is a graph of silencing activity of naproxen conjugated siRNAs in vitro in HeLa cells (Table 9).
Figure 35:
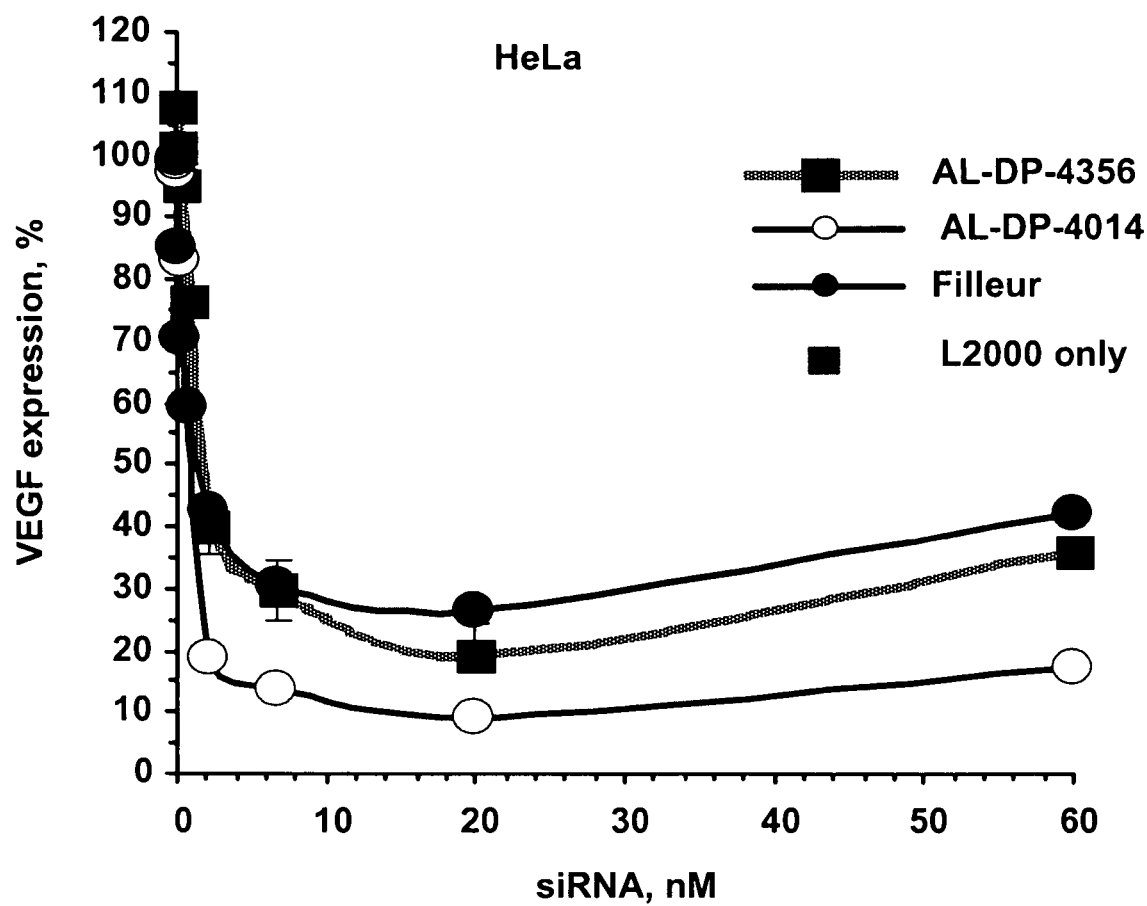
FIG. 35 is a graph of silencing activity of biotin conjugated siRNAs in vitro in HeLa cells (Table 10).
Figure 36:
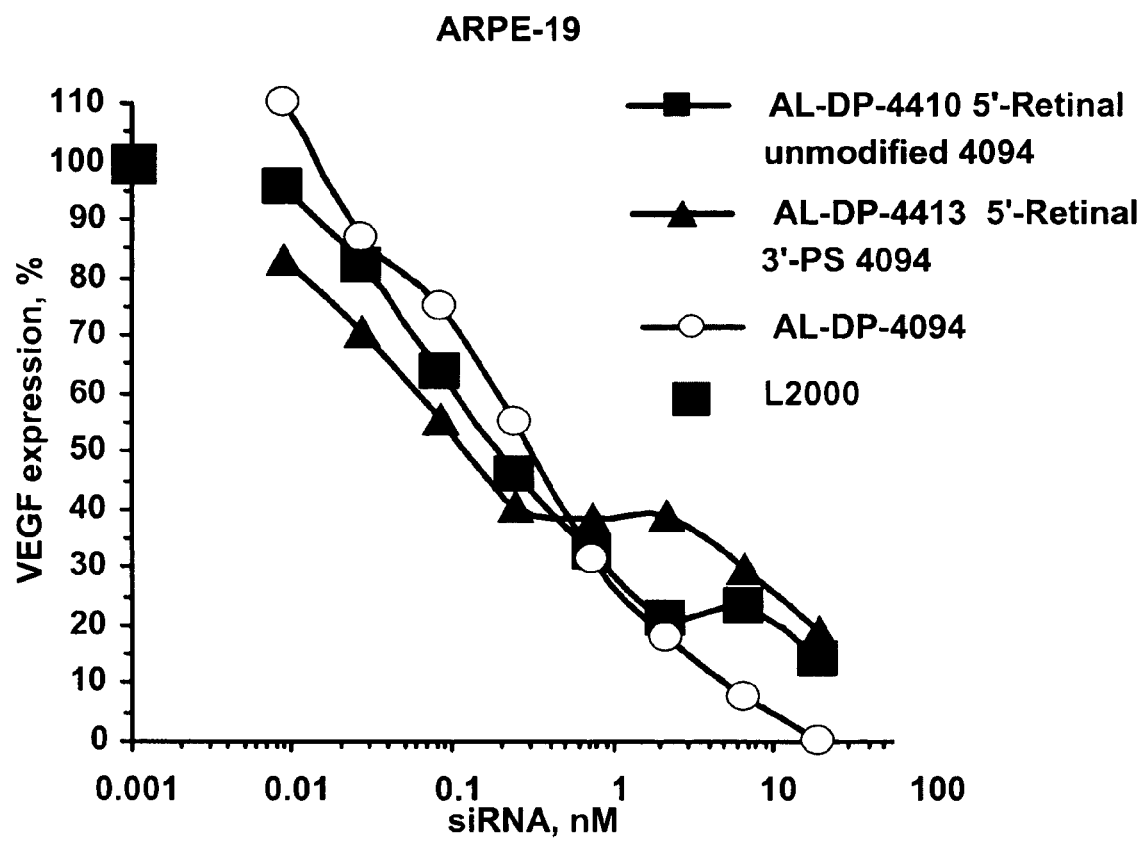
FIG. 36 is a graph of silencing activity of 5'-retinal conjugated siRNAs in vitro in HeLa cells (Table 11).
Figure 37:
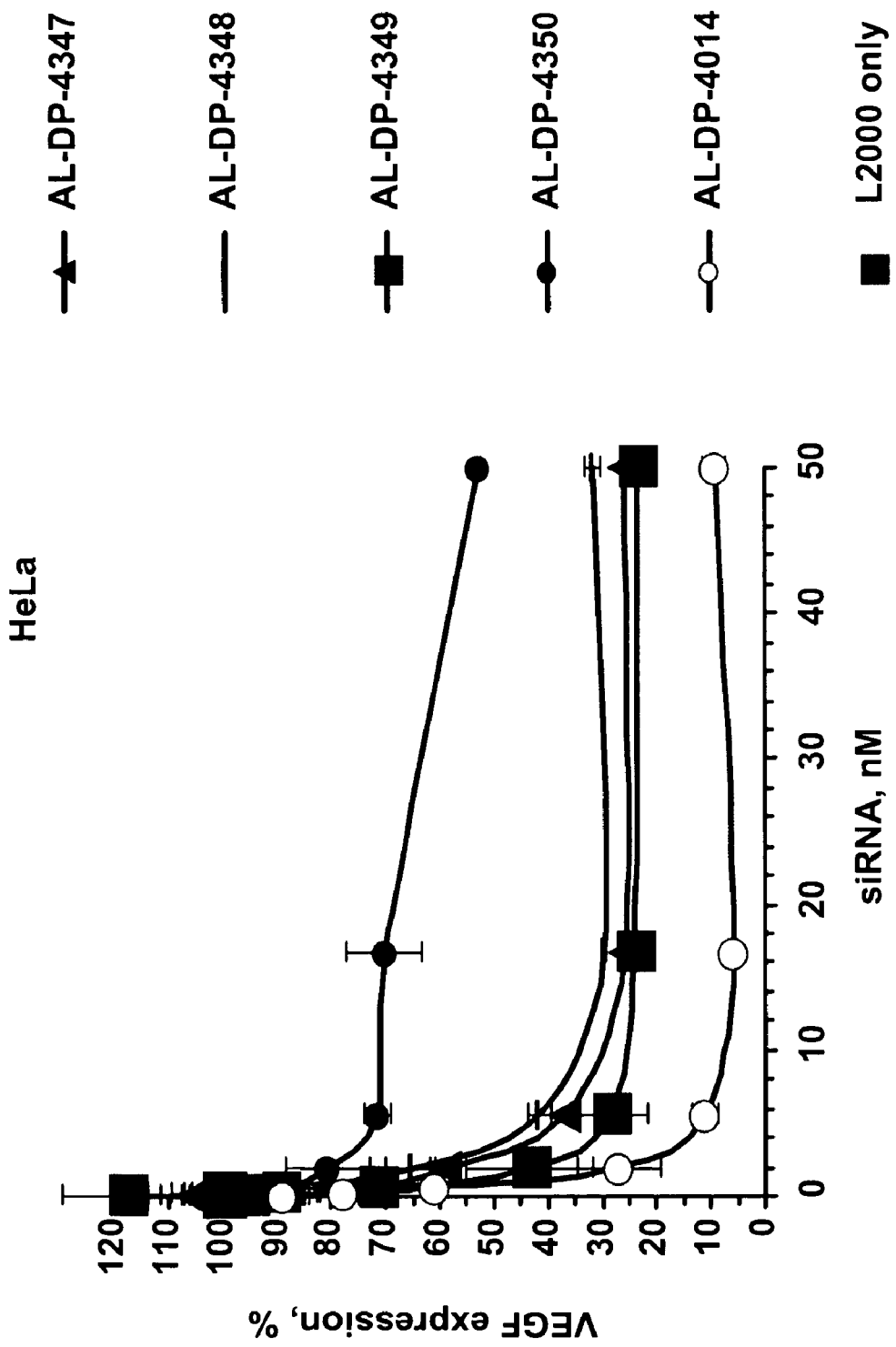
FIG. 37 is a graph of silencing activity of ribo-difluorotoluoyl modified siRNAs in vitro in HeLa cells (Table 13).

The stability of the AL-DP-4094 siRNA was examined by the Stains-All and radiolabeled techniques following incubation in human serum (see above). These assays revealed susceptibility to exo- and endonucleases. RP-HPLC was used to examine the fragment profile of the siRNA following incubation in serum FIG. 11.

Following incubation of the -4094 siRNA in human serum, the fragments were phenol-chloroform extracted and precipitated, and then subjected to LC/MS analysis. FIG. 12 describes the identified fragments and associated characteristics.

Example 8

Detailed Study of Modifications to siRNAs Targeting VEGF (Table 6)

Eight major different patterns of chemical modification of siRNA duplexes that target the VEGF mRNA were synthesized and evaluated (Table 6). The ribose sugar modifications used were either 2'-O-methyl (2'OMe) or 2'-fluoro (2'F). Both pyrimidines (Py) and purines (Pu) could be modified as provided in Table 6.

The first four patterns (A-D) incorporated 2'OMe on both strands at every other position. Four configurations were synthesized: 1) at each even position on the sense strand and at each odd position of the antisense strand, 2) at each odd position on the sense strand and at each even position of the antisense strand, 3) at even positions on both strands, and 4) at odd positions on both strands.

The fifth pattern (E) incorporated the 2'OMe modification at all pyrimidine nucleotides on both the sense and antisense strands of the duplex.

Pattern F included duplexes with 2'OMe modifications only on pyrimidines in 5'-PyPu-3' dinucleotides, especially at only at UA, CA, UG sites (both strands).

Pattern G duplexes had the 2'F modification on pyrimidines of the antisense strand and 2'OMe modifications on pyrimidines in the sense strand.

Pattern (H) had antisense strands with 2'F-modified pyrimidines in 5'-PyPu-3' dinucleotides, only at UA, CA, UG sites (both strands) and sense strands with 2'OMe modifications only on pyrimidines in 5'-PyPu-3' dinucleotides, only at UA, CA, UG sites (both strands).

A-D: Full Alternating 2'-OMe (both strands)
   Four configurations: Even/Odd; Odd/Even; Even/Even; Odd/Odd
E: 2'-OMe Py (both strands)
F: 2'-OMe Py only at UA, CA, UG sites (both strands)
G: 2'-OMe All Py (sense)
   2'-F All Py (anti-sense)
H: 2'-OMe Py only at UA, CA, UG sites (sense)
   2'-F Py only at UA, CA, UG sites (anti-sense)
17 different parent VEGF duplexes from Table 2 tested 1. Evaluation of Serum Stability of siRNA Duplexes 2 µM siRNA duplexes (final concentration) were incubated in 90% pooled human serum at 37° C. Samples were quenched on dry ice after 30 minutes, 4 hours, and 24 hours. For each siRNA sequence, a sample at the same concentration was incubated in the absence of serum (in PBS) at 37° C. for 24 hours. After all samples were quenched, RNA was extracted using phenol:chloroform and concentrated by ethanol precipitation. Samples were air dried and resuspended in a denaturing loading buffer. One third of each time point was analyzed on a 20% acrylamide (19:1), 7 M urea, 1×TBE gel run at 60° C. RNA was visualized by staining with stains-all solution. A qualitative assessment of the stability of each modified siRNA was made by comparison to the parent unmodified siRNA for each duplex set. PBS controls served as markers for the quality of the input siRNA.

2. Stability of VEGF Modular Chemistries

Four modular chemistries were screened 1) all pyrimidines substituted with 2'-O-methyl (2'OMe) in both sense and antisense strands, 2) pyrimidines in UA, UG, CA pairs substituted with 2'OMe in both sense and antisense strands, 3) all pyrimidines substituted with 2'OMe in the sense strand and 2'-fluoro (2'F) in the antisense strand, 4) pyrimidines in UA, UG, CA pairs substituted with 2'OMe in the sense strand and 2'F in the antisense strand. In total, 85 siRNAs were screened including the unmodified parent duplexes plus the four modular chemistries.

Of the 85 siRNAs screened, 35 were stable for at least 24 hours as assessed by visual comparison with the parent unmodified duplexes. These 35 duplexes had 2'OMe pyrimidines in both strands or 2'OMe pyrimidines in the sense strand and 2'F in the antisense strand (chemistries 1 and 3 above). Of the duplexes with fewer modified residues, only five had at least ~50% full length material remaining at the 4 hour time point as compared to their unmodified parent.

Substitution of all pyrimidines with either 2'OMe or 2'F protects siRNAs from serum nuclease degradation for ~24 hr in 90% human serum at 37° C. The protected duplexes had roughly 85%-100% full length material remaining at 24 hours as compared to duplex incubated in the absence of serum. Minimal modification of pyrimidines in UA, UG, and CA dinucleotide pairs only stabilized several siRNAs relative to their unmodified parent but did not stabilize sufficiently for long-term nuclease resistance. Some potential RNase A sites were not protected by methylation (YpN, e.g. UC, UU) and this is likely the reason for the lower resistance to serum endonucleases.

3. Analysis of Duplex Activity

Duplexes were tested for activity in the HeLa cell assay described above. Table 6 and FIGS. 13-29 provides summary and graphs of duplex activities in HeLa cells for each of the modifications described above.

Synthesis of the iRNA Agents

RNA Synthesis Using "Fast" Deprotection Monomers

1. RNA Synthesis

Oligoribonucleotides were synthesized using phosphoramidite technology on solid phase employing an AKTA 10 synthesizer (Amersham Biosciences) at scales ranging from 35 to 60 µmol. Synthesis was performed on solid supports made of controlled pore glass (CPG, 520 Å, with a loading of 70 µmol/g) or polystyrene (with a loading of 71 µmol/g). All amidites were dissolved in anhydrous acetonitrile (70 mM) and molecular sieves (3 Å) were added. 5-Ethyl thiotetrazole (ETT, 600 mM in acetonitrile) was used as the activator solution. Coupling times were 8 minutes. Oxidation was carried out either with a mixture of iodine/water/pyridine (50 mM/10%/90% (v/v)) or by employing a 100 mM solution of 3-ethoxy-1,2,4-dithiazoline-5-one (EDITH) in anhydrous acetonitrile in order to introduce phosphorothioate linkages. Standard capping reagents were used. Cholesterol was conjugated to RNA via the either the 5' or the 3'-end of the sense strand by starting from a CPG modified with cholesterol (described below) using a hydroxyprolinol linker. The DMT protecting group was removed from cholesterol-conjugated RNA, but the DMT was left on unconjugated RNA to facilitate purification.

2. Cleavage and Deprotection of Support Bound Oligonucleotide.

After solid-phase synthesis, the RNA was cleaved from the support by passing 14 mL of a 3:1 (v/v) mixture of 40% methylamine in water and methylamine in ethanol through the synthesis column over a 30 min time period. For the cholesterol-conjugated RNA, the ratio of methylamine in water to methylamine in ethanol was 1:13. The eluent was divided into four 15 mL screw cap vials and heated to 65° C. for additional 30 min. This solution was subsequently dried down under reduced pressure in a speedvac. The residue in each vial was dissolved in 250 µL N-methylpyrrolidin-2-one (NMP), and 120 µL triethylamine (TEA) and 160 µL TEA·3HF were added. This mixture was brought to 65° C. for 2 h. After cooling to ambient temperature, 1.5 mL NMP and 1 mL of ethoxytrimethylsilane were added. After 10 min, the oligoribonucleotide was precipitated by adding 3 mL of ether. The pellets were collected by centrifugation, the supernatants were discarded, and the solids were reconstituted in 1 mL buffer 10 mM sodium phosphate.

3. Purification of Oligoribonucleotides

Crude oligonucleotides were purified by reversed phase HPLC on an AKTA Explorer system (Amersham Biosciences) using a 16/10 HR column (Amersham Biosciences) packed to a bed height of 10 cm with Source RPC 15. Buffer A was 10 mM sodium phosphate and buffer B contained 65% acetonitrile in buffer A. A flow rate of 6.5 mL/min was employed. UV traces at 260, 280, and 290 nm were recorded. For DMT-on oligoribonucleotides a gradient of 7% B to 45% B within 10 column volumes (CV) was used and for cholesterol-conjugated RNA a gradient of 5% B to 100% B within 14 CV was employed. Appropriate fractions were pooled and concentrated under reduced pressure to roughly 10 mL. DMT-on oligonucleotides were treated with one-third volume 1M NaOAc, pH 4.25 for several hours at ambient temp.

Finally, the purified oligonucleotides were desalted by size exclusion chromatography on a column containing Sephadex G-25. The oligonucleotide solutions were concentrated to a volume <15 mL. The concentrations of the solutions were determined by measurement of the absorbance at 260 nm in a UV spectrophotometer. Until annealing the individual strands were stored as frozen solutions at −20° C.

4. Analysis of Oligoribonucleotides

Cholesterol conjugated RNA was analyzed by CGE and LC/MS. Unconjugated RNA was also analyzed by IEX-HPLC. CGE analysis was performed on a BeckmanCoulter PACE MDQ CE instrument, equipped with a fixed wavelength detector at 254 nm. An eCap DNA capillary (BeckmanCoulter) with an effective length of 20 cm was used. All single stranded RNA samples were analyzed under denaturing conditions containing 6 M urea (eCap ssDNA 100 Gel Buffer Kit, BeckmanCoulter) at 40° C. Samples were injected electrokinetically with 10 kV for 5-8 sec. The run voltage was 15 kV.

IEX HPLC analysis was performed on a Dionex BioLC system equipped with a fixed wavelength detector (260 and 280 nm), column oven, autosampler, and internal degasser. A Dionex DNAPac P100 column (4*250 mm) was used as at a flow rate of 1.0 mL/min and 30° C. Unconjugated RNA (20 µL, 1 OD/mL concentration) was injected. Eluent A contained 20 mM $Na_2HPO_4$, 10 mM NaBr, 10% acetonitrile, pH 11 and Eluent B was 1 M NaBr in Eluent A. The elution started with 20% B for 1 min and then a linear gradient with a target concentration of 80% B over 20 min was employed.

LC-MS analysis was performed on an Ettan µLC-system (Amersham Bioscience) equipped with a Jetstream column heater and a fixed wavelength detector (254 nm). A ThermoFinnigan LCQ DecaXP ESI-MS system with micro-spray source and ion trap detector was coupled online to the HPLC. Oligonucleotide samples (25 µL sample, 1 OD/mL concentration in water for unconjugated RNA and 40 µL for cholesterol-conjugated RNA) were injected onto a Waters Xterra C8 MS column (2.1×50 mm; 2.5 µm particle size) with a flow rate of 200 µL/min at 60° C. Composition of eluent A was 400 mM hexafluoroisopropanol (HFIP), 16.3 mM TEA in $H_2O$, pH 7.9 and eluent B was methanol. For unconjugated RNA elution started with 7% B for 3 min and then a gradient from 7% B to 25% B in 13 min was used. For cholesterol-conjugated material the starting conditions were 35% B for 3 min and then the concentration of eluent B was increased to 75% B in 30 min. Analysis figures are provided in Table 6.

5. Annealing of Oligoribonucleotides

Complementary strands were annealed by combining equimolar RNA solutions. The mixture was lyophilized and reconstituted with an appropriate volume of annealing buffer (100 mM NaCl, 20 mM sodium phosphate, pH 6.8) to achieve the desired concentration. This solution was placed into a water bath at 95° C. and then cooled to ambient temp. within 3 h. Extent of duplex formation was monitored by native 10% polyacrylamide gel electrophoresis (PAGE) and bands were visualized by staining with the "stains all" reagent (Sigma).

RNA Synthesis Using "Standard" Deprotection Monomers Including Ribo and 2'-O-Methyl Phosphoramidites.

A. RNA/2'OMe (Thioate Ends)

The chimeric RNA molecules with 2'-OMe nucleotides were synthesized on a 394 ABI machine using the standard cycle written by the manufacturer with modifications to a few wait steps. The solid support was CPG (500 A). The monomers were either RNA phosphoramidites or 2' OMe RNA phosphoramidites with standard protecting groups and used at concentrations of 0.15 M in acetonitrile ($CH_3CN$) unless otherwise stated. Specifically the RNA phosphoramidites were 5'-O-Dimethoxytrityl-$N^6$-benzoyl-2'-O-tbutyldimethylsilyl-adenosine-3'-O-(β-cyanoethyl-N,N'-diisopropyl) phosphoramidite, 5'-O-Dimethoxytrityl-$N^2$-isobutyryl-2'-O-tbutyldimethylsilyl-guanosine-3'-O-(β-cyanoethyl-N,N'-diisopropyl)phosphoramidite, 5'-O-Dimethoxytrityl-$N^4$-acetyl-2'-O-tbutyldimethylsilyl-cytidine-3'-O-(β-cyanoethyl-N,N'-diisopropyl)phosphoramidite and 5'-O-Dimethoxytrityl-2'-O-tbutyldimethylsilyl-uridine-3'-O-(β-cyanoethyl-N,N'-diisopropyl)phosphoramidite; the 2'OMe RNA phosphoramidites were 5'-O-Dimethoxytrityl-$N^6$-benzoyl-2'-O-methyl-adenosine-3'-O-(β-cyanoethyl-N,N'-diisopropyl) phosphoramidite, 5'-O-Dimethoxytrityl-$N^2$-isobutyryl-2'-O-methyl-guanosine-3'-O-(β-cyanoethyl-N, N'-diisopropyl)phosphoramidite, 5'-O-Dimethoxytrityl-$N^4$-acetyl-2'-O-methyl-cytidine-3'-O-(β-cyanoethyl-N,N'-diisopropyl)phosphoramidite and 5'-O-Dimethoxytrityl-2'-O-methyl-uridine-3'-O—)β-cyanoethyl-N,N'-diisopropyl) phosphoramidite. The coupling times were 10 min for all monomers. Details of the other reagents are as follows: Activator: 5-(ethylthio)-1H-tetrazole (0.25M); Cap A: 5% acetic anhydride/THF/pyridine; Cap B: 10% N-methylimidazole/THF. Phosphate oxidation involved THBP (10% in ACN) for 10 min while phosphorothioate oxidation utilized 0.05 M EDITH reagent/acetonitrile. Detritylation was achieved with 3% TCA/dichloromethane. The DMT protecting group was removed after the last step of the cycle.

After completion of synthesis the controlled pore glass (CPG) was transferred to a screw cap, sterile microfuge tube. The oligonucleotide was cleaved and simultaneously the base and phosphate groups deprotected with 1.0 mL of a mixture of ethanolic methylamine:ammonia (8 M methylamine in ethanol/30% aq ammonia) (1:1) for 5 hours at 55° C. The tube was cooled briefly on ice and then the solution was transferred to a 5 mL centrifuge tube; this was followed by washing three times with 0.25 mL of 50% acetonitrile. The tubes were cooled at −80° C. for 15 min, before drying in a lyophilizer.

The white residue obtained was resuspended in 200 uL of NMP/$Et_3$N/$Et_3$N—HF and heated at 65° C. for 1.5 h to remove the TBDMS groups at the 2'-position. The oligonucleotides were then precipitated in dry diethyl ether (400 uL) containing $Et_3$N (1%). The liquid was removed carefully to yield a pellet at the bottom of the tube. Residual ether was removed in the speed vacuum to give the "crude" RNA as a white fluffy material. Samples were dissolved in 1 mL RNase free water and quantitated by measuring absorbance at 260 nm. This crude material was stored at −20° C.

The crude oligonucleotides were analyzed and purified by HPLC. The crude oligonucleotides were analyzed and purified by Reverse Phase IonPair (RP IP) HPLC. The RP HPLC analysis was performed on a Gilson LC system, equipped with a fixed wavelength detector (260 and 280 nm), column oven, autosampler and internal degasser. An XTerra C18 column (4.6*250 mm) was used at a flow rate of 1.0 mL/min at 65° C. RNA (20 μL for analytical run, 1 mL for a preparative run at 1 OD/mL concentration) was injected. Eluent A contained 0.1 M TEAAc, HPLC water, pH 7.0 and Eluent B was 0.1 M TEAAc in HPLC water, 70% acetonitrile, pH 7.0. The elution started with 10% B for 2 min, followed by 25% B in 4 min and then a linear gradient with a target concentration of 50% B over another 30 min was employed. The purified dry oligonucleotides were then desalted using Sephadex G25M.

B. Synthesis of Oligonucleotides with 2'-Fluoro Modifications

The RNA molecules were synthesized on a 394 ABI machine using the standard cycle written by the manufacturer with modifications to a few wait steps. The solid support was CPG (500 A, TsT AG 001 from AM Chemicals LLC and the rC and rU were from Prime Synthesis). The monomers were either RNA phosphoramidites or 2'F phosphoramidites with standard protecting groups and used at concentrations of 0.15 M in acetonitrile ($CH_3CN$) unless otherwise stated. Specifically the RNA phosphoramidites were 5'-O-Dimethoxytrityl-$N^6$-benzoyl-2'-O-tbutyldimethylsilyl-adenosine-3'-O-(β-cyanoethyl-N,N'-diisopropyl) phosphoramidite, 5'-O-Dimethoxytrityl-$N^2$-isobutyryl-2'-O-tbutyldimethylsilyl-guanosine-3'-O-(β-cyanoethyl-N,N'-diisopropyl) phosphoramidite, 5'-O-Dimethoxytrityl-$N^4$-acetyl-2'-O-tbutyldimethylsilyl-cytidine-3'-O-(β-cyanoethyl-N,N'-diisopropyl)phosphoramidite, and 5'-O-Dimethoxytrityl-2'-O-tbutyldimethylsilyl-uridine-3'-O-(β-cyanoethyl-N,N'-diisopropyl)phosphoramidite; the 2'F RNA phosphoramidites were 5'-O-Dimethoxytrityl-$N^4$-acetyl-2'-fluoro-2'-deoxy-cytidine-3'-O-(β-cyanoethyl-N,N'-diisopropyl)phosphoramidite and 5'-O-Dimethoxytrityl-2'-fluoro-2'-deoxy-uridine-3'-O—(O-cyanoethyl-N,N'-diisopropyl) phosphoramidite. The coupling times were 10 min for all monomers. Details of the other reagents are as follows: Activator: 5-ethyl thiotetrazole (0.25 M); Cap A: 5% acetic anhydride/THF/pyridine; Cap B: 10% N-methylimidazole/THF; phosphate oxidation involved THBP (10% in ACN) for 10 min while phosphorothioate oxidation utilized 0.05 M EDITH reagent/acetonitrile. Detritylation was achieved with 3% TCA/dichloromethane. The DMT protecting group was removed after the last step of the cycle.

After completion of synthesis, CPG was transferred to a screw cap, sterile microfuge tube. The oligonucleotide was cleaved and the base and phosphate groups were simultaneously deprotected with 1.0 mL of a mixture of ethanolic ammonia (1:3) for 7 hours at 55° C. The tube was cooled briefly on ice and then the solution was transferred to a 5 mL centrifuge tube; this was followed by washing three times with 0.25 mL of 50% acetonitrile. The tubes were cooled at −80° C. for 15 min, before drying in a lyophilizer.

The white residue obtained was resuspended in 200 uL of NMP/$Et_3$N/$Et_3$N—HF and heated at 50° C. for 16 h to remove the TBDMS groups at the 2' position. The oligonucleotides were then precipitated in dry diethyl ether (400 uL) containing $Et_3$N (1%). The liquid was removed carefully to yield a pellet at the bottom of the tube. Residual ether was removed in the speed vacuum to give the "crude" RNA as a white fluffy material. Samples were dissolved in 1 mL RNase free water and quantitated by measuring the absorbance at 260 nm. This crude material was stored at −20° C.

The crude oligonucleotides were analyzed and purified by HPLC. The purified dry oligonucleotides were then desalted using Sephadex G25M.

C. Synthesis of Phosphorothioate RNA Oligoribonucleotides

The oligonucleotides were synthesized on a 394 ABI machine (ALN 0208) using the standard 93 step cycle written by the manufacturer with modifications to a few steps as described below. The solid support was controlled pore glass (CPG, 2 μmole rA CPG, 520 A, or rU CPG, 500 A). The monomers were RNA phosphoramidites with standard protecting groups used at concentrations of 0.15 M in acetonitrile (CH$_3$CN) unless otherwise stated. Specifically the RNA phosphoramidites were 5'-O-Dimethoxytrityl-N$^6$-benzoyl-2'-O-tbutyldimethylsilyl-adenosine-3'-O-(β-cyanoethyl-N,N'-diisopropyl) phosphoramidite, 5'-O-Dimethoxytrityl-N$^2$-isobutyryl-2'-O-tbutyldimethylsilyl-guanosine-3'-O-(β-cyanoethyl-N,N'-diisopropyl)phosphoramidite, O-Dimethoxytrityl-N$^4$-acetyl-2'-O-tbutyldimethylsilyl-cytidine-3'-O-(β-cyanoethyl-N,N'-diisopropyl)phosphoramidite and 5'-O-Dimethoxytrityl-2'-O-tbutyldimethylsilyl-uridine-3'-O-(β-cyanoethyl-N,N'-diisopropyl)phosphoramidite. The coupling times were 10 min. Details of the other reagents are as follows: activator: 5-ethyl thiotetrazole (0.25M); Cap A: 5% acetic anhydride/THF/pyridine; Cap B: 10% N-methylimidazole/THF; PS-oxidation, 0.05M EDITH reagent/acetonitrile. Detritylation was achieved with 3% TCA/dichloromethane.

After completion of synthesis the CPG was transferred to a screw cap sterile microfuge tube. The oligonucleotide was cleaved and simultaneously the base and phosphate groups deprotected with 1.0 mL of a mixture of ethanolic methylamine:ammonia (1:1) for 5 hours at 55° C. The tube was cooled briefly on ice and then the solution was transferred to a 5 mL centrifuge tube; this was followed by washing with 3×0.25 mL of 50% acetonitrile. The tubes were cooled at −80° C. for 15 min, before drying in a lyophilizer.

The white residue obtained was resuspended in 200 μL of TEA 3HF and heated at 65° C. for 1.5 h to remove the TBDMS groups at the 2'-position. The oligonucleotides were then precipitated by addition of 400 μL dry MeOH. The liquid was removed after spinning in a microcentrifuge for 5 minutes on the highest speed available. Residual methanol was removed in speed vacuum. Samples were dissolved in 1 mL RNase free water and quantitated by measuring the absorbance at 260 nm. The crude material was stored at −20° C. The oligonucleotides were analyzed and purified by HPLC and then desalted using Sephadex G25M.

Example 9

Synthesis of Oligonucleotides with Alternating 2'-F RNA and 2'O-Me RNA (Table 7)

A. Synthesis of CPGs for 2'F.

CPGs of 5'-O-DMTr-2'-deoxy-2'-fluororibonucleosides with appropriate base protection were synthesized as shown in Scheme A. 5'-O-DMTr-2'-Deoxy-2'-fluoro-N$^{Bz}$-A and 5'-O-DMTr-2'-Deoxy-2'-fluoro-N$^{iBu}$-G were synthesized as reported (Kawasaki et al., J. Med. Chem., 1993, 36, 831). Reaction of compounds 1001 with succinic anhydride in the presence of DMAP in ethylenedichloride yielded compound 1005. Compound 1005 was treated with 2,2'-dithiobis(5-nitropyridine) (DTNP) and triphenylphosphine in the presence of DMAP in acetonitrile-ethylenedichloride and subsequently with lcaa CPG as reported by Kumar et al. (Nucleosides & Nucleotides, 1996, 15, 879) yielded the desired CPG 1009. Loading of the CPG was determined as reported in the literature (Prakash et al., J. Org. Chem., 2002, 67, 357). CPGs of suitably protected 2'-deoxy-2'-fluoro A, C and G were obtained as described above (Scheme A).

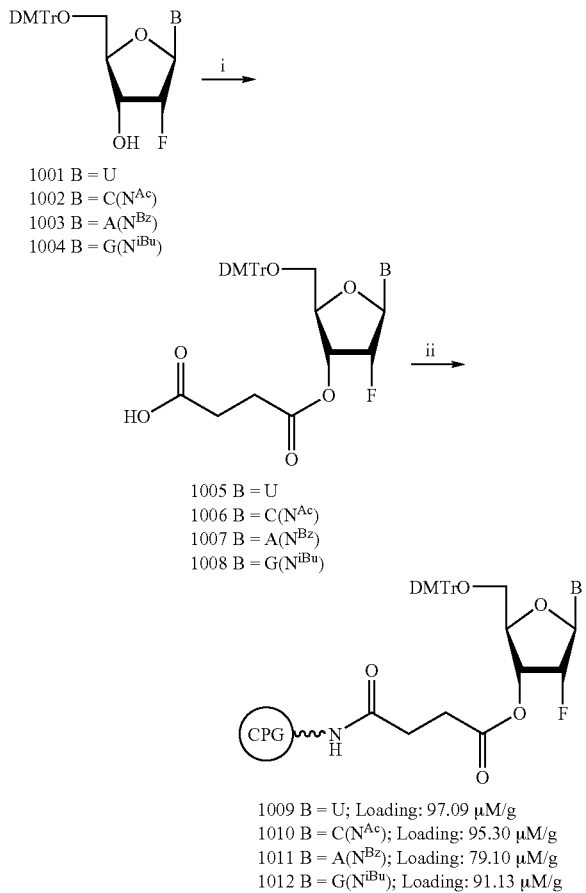

Scheme A$^a$: lcaa CPG of 2'-deoxy-2'-F A(N$^{Bz}$), C(N$^{Ac}$), G(N$^{iBu}$) and U 1001 B = U
1002 B = C(N$^{Ac}$)
1003 B = A(N$^{Bz}$)
1004 B = G(N$^{iBu}$)

1005 B = U
1006 B = C(N$^{Ac}$)
1007 B = A(N$^{Bz}$)
1008 B = G(N$^{iBu}$)

1009 B = U; Loading: 97.09 μM/g
1010 B = C(N$^{Ac}$); Loading: 95.30 μM/g
1011 B = A(N$^{Bz}$); Loading: 79.10 μM/g
1012 B = G(N$^{iBu}$); Loading: 91.13 μM/g $^a$(i) Succinic anhydride, DMAP/EDC
(ii) DTNP, Ph$_3$P, DMAP and lcaa CPG.

The chimeric RNA molecules with alternating 2'-F RNA and 2'O-Me RNA were synthesized on a 394 ABI machine using the standard cycle written by the manufacturer with modifications to a few wait steps. The solid support were CPG (500 A). The monomers were either 2'-F RNA phosphoramidites or 2' OMe RNA phosphoramidites with standard protecting groups and used at concentrations of 0.15 M in acetonitrile (CH$_3$CN) unless otherwise stated. Specifically the 2'OMe RNA phosphoramidites were 5'-O-Dimethoxytrityl-N$^6$-benzoyl-2'-O-methyl-adenosine-3'-O-(β-cyanoethyl-N,N'-diisopropyl) phosphoramidite, 5'-O-Dimethoxytrityl-N$^2$-isobutyryl-2'-O-methyl-guanosine-3'-O-(β-cyanoethyl-N,N'-diisopropyl)phosphoramidite, 5'-O-Dimethoxytrityl-N$^4$-acetyl-2'-O-methyl-cytidine-3'-O-(β-cyanoethyl-N,N'-diisopropyl)phosphoramidite and 5'-O-Dimethoxytrityl-2'-O-methyl-uridine-3'-O-(β-cyanoethyl-N,N'-diisopropyl) phosphoramidite. The 2'F RNA phosphoramidites 5'-O-

Dimethoxytrityl-N⁴-acetyl-2'-fluoro-2'-deoxy-cytidine-3'-O-(β-cyanoethyl-N,N'-diisopropyl)phosphoramidite, 5'-O-Dimethoxytrityl-2'-fluoro-2'-deoxy-uridine-3'-O-(β-cyanoethyl-N,N'-diisopropyl)phosphoramidite. 5'-O-Dimethoxytrityl-2'-fluoro-N²-isobutyryl-2'-deoxy-guanosine-3'-O-(β-cyanoethyl-N,N'-diisopropyl) phosphoramidite and 5'-O-Dimethoxytrityl-2'-fluoro-N²-isobutyryl-2'-deoxy-guanosine-3'-O-(β-cyanoethyl-N,N'-diisopropyl)phosphoramidite. The coupling times were 10 min for all monomers. Details of the other reagents are as follows: Activator: 5-ethyl thiotetrazole (0.25M); Cap A: 5% acetic anhydride/THF/pyridine; Cap B: 10% N-methylimidazole/THF; phosphate oxidation involved 0.02 M I$_2$/THF/H$_2$O, while PS-oxidation was carried out using EDITH reagent as described above. Detritylation was achieved with 3% TCA/dichloromethane. The final DMT protecting group was removed in the synthesizer.

After completion of synthesis the CPG was transferred to a screw cap, sterile microfuge tube. The oligonucleotide was cleaved and the base and phosphate groups were simultaneously deprotected with 1.0 mL of a mixture of ethanolic: ammonia (1:3) for 7 hours at 55° C. The tube was cooled briefly on ice and then the solution was transferred to a 5 mL centrifuge tube; this was followed by washing three times with 0.25 mL of 50% acetonitrile. The tubes were cooled at −80° C. for 15 min before drying in a lyophilizer to give the "crude" RNA as a white fluffy material. Samples were dissolved in 1 mL RNase free water and quantitated by measuring the absorbance at 260 nm. This crude material was stored at −20° C.

The crude oligonucleotides were analyzed and purified by 20% polyacrylimide denaturing gels. The purified dry oligonucleotides were then desalted using Sephadex G25M (Amersham Biosciences).

B. Analysis of Duplex Activity

Duplexes were tested for activity in the HeLa cell assay described above. Table 7 and FIG. 30 provides graphs of the activities in HeLa cells for each of the modifications described above.

Example 10

Conjugated VEGF Molecules (Tables 8, 9, 10 and 18)

1. Synthesis:

The RNA molecules were synthesized on an ABI-394 machine (Applied Biosystems) using the standard 93 step cycle written by the manufacturer with modifications to a few wait steps as described below. The solid support was controlled pore glass (CPG, 1 umole, 500 A) and the monomers were RNA phosphoramidites with standard protecting groups (5'-O-dimethoxytrityl-N-6-benzoyl-2'-O-t-butyldimethylsilyl-adenosine-3'-O—N,N'-diisopropyl-2-cyanoethylphosphoramidite, 5'-O-dimethoxytrityl-N4-acetyl-2'-O-t-butyldimethylsilyl-cytidine-3'-O—N,N'-diisopropyl-2-cyanoethylphosphoramidite, 5'-O-dimethoxytrityl-N2-isobutryl-2'-O-t-butyldimethylsilyl-guanosine-3'-O—N,N'-diisopropyl-2-cyanoethylphosphoramidite, and 5'-O-dimethoxytrityl-2'-O-t-butyldimethylsilyl-uridine-3'-O—N,N'-diisopropyl-2-cyanoethylphosphoramidite. All amidites were used at a concentration of 0.15M in acetonitrile (CH$_3$CN) and a coupling time of 6 min for unmodified and 2'-O-Me modified monomers and 12 min for modified and conjugated monomers. 5-ethyl thiotetrazole (0.25M) was used as an activator. For the PO-oxidation Iodine/Water/Pyridine and for PS-oxidation Beaucage reagent (2%) in anhy. acetonitrile was used. The sulfurization time was about 6 min. All syntheses was performed on a 1 umole scale.

| Reagents | Concentration | | Wait or Coupling step |
|---|---|---|---|
| Activator: | 0.25M | 5-Ethylthio-1H-tetrazole | 720 sec |
| PO-oxidation | 0.02M | Iodine in THF/Water/Pyridine | 20 sec |
| PO-oxidation | 0.02M | t-Butyl-hydrogen peroxide | 600 sec |
| PS-oxidation | 2% | Beaucage reagent/anhy. Acetonitrile | 360 Sec (200 sec, wait +30 sec pulse +130 sec wait |
| Cap A | 5% | 5% Phenoxyacetic anhydride/THF/pyridine | 20 sec |
| Cap B | 10% | 10% N-methylimidazole/THF | 20 sec |
| Detritylation | 3% TCA | Trichloro Acetic Acid/dichloromethane | 70 sec |

The following types of modifications were used to perform the synthesis using these protocols:
 1. Unmodified phosphodiester backbone (PO) only
 2. Phosphorothioate (PS) only
 3. 2'-O-Me, PS
 4. 3'-Naproxen, 2'F-5Me-U, PS
 5. 5'-Cholesterol, PS
 6. 3'-Cholesterol, PS
 7. 2'F-5Me-U, PS
 8. 3'-Biotin, 2'F-5Me-U, PS
 9. 3'-cholanic acid, 2'F-5Me-U, PS
 10. Methylphosphonate
 11. C-5 allyamino rU
 2. Deprotection-I (Nucleobase Deprotection)

After completion of the synthesis, the controlled pore glass (CPG) was transferred to a screw cap vial or screw cap RNase free microfuge tube. The oligonucleotide was cleaved from the support and the base and phosphate protecting groups were simultaneously removed by using of a mixture of ethanolic ammonia (ammonia (28-30%:ethanol (3:1))-(1.0 mL) for 15 h at 55° C. The vial was cooled briefly on ice and then the ethanolic ammonia mixture was transferred to a new microfuge tube. The CPG was washed with portions of deionized water (2×0.1 mL). The supernatant was combined, cooled in dry ice for 10 min and then dried in a speed vac.

3. Deprotection-II (Removal of 2'-O-TBDMS Group)

The white residue obtained was resuspended in a mixture of triethylamine, triethylamine trihydrofluoride (TEA.3HF ca. 24% HF)) and 1-Methyl-2-Pyrrolidinone (NMP) (4:3:7) (400 ul) and heated at 65° C. for 90 min to remove the tert-butyldimethylsilyl (TBDMS) groups at the 2'-position. The reaction was then quenched with isopropoxytrimethylsilane (iPrOMe$_3$Si, 400 ul) and further incubated on the heating block leaving the caps open for 10 min; This causes the volatile isopropoxytrimethylsilylfluoride adduct to vaporize. The residual quenching reagent was removed by drying in a speed vac. 3% Triethylamine in diethyl ether (1.5 ml) was added. The mixture was subjected to centrifugation. A pellet of RNA formed. The supernatant was pipetted out without disturbing the pellet. The pellet was dried in a speed vac. The crude RNA was obtained as a white fluffy material in the microfuge tube.

4. Quantitation of Crude Oligomer or Raw Analysis

Samples were dissolved in deionized water (1.0 mL) and quantitated as follows: Blanking was first performed with water alone (1 mL). A sample of the RNA solution (20 ul) was diluted with water (980 uL) and mixed well in a microfuge tube, then transferred to a cuvette and the absorbance reading was obtained at 260 nm. The crude material was dried down and stored at −20° C.

5. MS Analysis:

The crude samples (0.1 OD) analyzed using LC-MS.

6. Purification of Oligomers (a) Polyacrylamide Gel Electrophoresis (PAGE) Purification The oligonucleotides were purified by vertical slab polyacrylamide gel electrophoresis (PAGE) using an Owl's Separation Systems (Portsmouth, N.H.). Electrophoresis grade acrylamide (40%), N,N'-methylene-bis(acrylamide) (BIS), ammonium persulfate (APS, N,N,N'N'-tetramethylenediamine (TEMED), bromophenol blue (BPB), xylene cyanol (XC) 10×TBE (0.89 M tris-hydroxy-methylaminomethane, borate pH 8.3, 20 mM disodium ethylenediaminetetraacetate) were from National Diagnostics (Atlanta, Ga.). The 12% denaturing gel was prepared for purification of unmodified and modified oligoribonucleotides. The thickness of the preparative gels was 1.5 mm. Loading buffer was 80% formamide in 10×TBE. After removal of the glass plates, the gels were covered with Saran Wrap® and placed over a fluorescent TLC plate illuminated by a hand-held UV lamp for visualization. The desired bands were excised and shaken overnight in 2 mL of water or 0.03 M Sodium Acetate. The eluent was removed by drying in a speed vac.

(b) High Performance Liquid chromatography (HPLC) Purification:

Condition A: Purification of unmodified, 2'-O-Me/PS Oligoribonucleotides:

Amount of injected sample is about ~100 OD.
Column: Dionex PA-100 Semiprep.
Buffer A: Water
Buffer B: 0.25 M Tris.Cl pH 8.0
Buffer C, 0.375 M Sod.Perchlorate
Heating: 65° C.

| Time | Flow | Buffer A | Buffer B | Buffer C | Total Yield | Purity |
|---|---|---|---|---|---|---|
| 0 | 5.00 | 88% | 10% | 2.0% | 40–60% | 85–98% |
| 3.0 | 5.00 | 88% | 10% | 2.0% | | |
| 30.0 | 5.00 | 57.0 | 10% | 33.0 | | |
| 35.0 | 5.00 | 88% | 10% | 2.0% | | |
| 40.0 | 5.00 | 88% | 10% | 2.0% | | |

Condition B: Protocols for Purification of 2'-O-Me/PS Oligoribonucleotides:

Column: Dionex PA-100 Semiprep.
Buffer A: Water
Buffer B 0.25 M Tris.Cl pH 8.0
Buffer C 0.8 M Sod.Perchlorate
Heating: 65° C.

| Time | Flow | Buffer A | Buffer B | Buffer C | Total Yield | Purity |
|---|---|---|---|---|---|---|
| 0 | 5.00 | 88% | 10% | 2.0% | ~40–60% | 85–98% |
| 3.0 | 5.00 | 88% | 10% | 2.0% | | |
| 30.0 | 5.00 | 57.0 | 10% | 33.0 | | |
| 35.0 | 5.00 | 88% | 10% | 2.0% | | |
| 40.0 | 5.00 | 88% | 10% | 2.0% | | |

7. Desalting of Purified Oligomer

The purified dry oligomer was then desalted using Sephadex G-25 M. The cartridge was conditioned with 10 mL of deionised water thrice. Finally the purified oligomer dissolved thoroughly in 2.5 mL RNAse free water was applied to the cartridge with a very slow drop-wise elution. The salt free oligomer was eluted with 3.5 ml deionized water directly into a screw cap vial. The purified RNA material was dried down in speed vac and stored at −20° C.

Biotin Conjugated siRNAs (Table 10)

1. Synthesis:

The RNA molecules were synthesized on an ABI-394 machine (Applied Biosystems) using the standard 93 step cycle written by the manufacturer with modifications to a few wait steps as described below. The solid support was controlled pore glass (CPG, 1 umole, 500 A) and the monomers were RNA phosphoramidites with standard protecting groups (5'-O-dimethoxytrityl N6-Benzoyl-2'O-t-butyldimethylsilyl-adenosine-3'-O—N,N'-diisopropyl-2-cyanoethylphosphoramidite, 5'-O-dimethoxytrityl-N4-acetyl-2'-O-t-butyldimethylsilyl-cytidine-3'-O—N,N'-diisopropyl-2-cyanoethylphosphoramidite, 5'-O-dimethoxytrityl-N2-isobutryl-2'-O-t-butyldimethylsilyl-guanosine-3'-O—N,N'-diisopropyl-2-cyanoethylphosphoramidite, and 5'-O-dimethoxytrityl-2'-O-t-butyldimethylsilyl-uridine-3'-O—N,N'-diisopropyl-2-cyanoethylphosphoramidite. The modified CPG and amidites were synthesized using known methods and as described herein. All amidites were used at a concentration of 0.15M in acetonitrile ($CH_3CN$) and a coupling time of 6 min for unmodified and 2'-O-Me monomers and 12 min for modified and conjugated monomers. 5-Ethylthio-1H-tetrazole (0.25M) was used as an activator. For the PO-oxidation Iodine/Water/Pyridine and for PS-oxidation Beaucage reagent (2%) in anhy. acetonitrile was used. The sulfurization time is about 6 min. For synthesis of 3'-biotin conjugated siRNAs, t-butyl-hydrogen peroxide was used as oxidizing agent (oxidation time 10 min).

| Reagent | Concentration | | Wait or Coupling step |
|---|---|---|---|
| Activator: | 0.25M | 5-Ethylthio-tetrazole | 300 sec for unmodified and 720 sec for modified oligos. |
| PO-oxidation | 0.02M | Iodine in THF/water/pyridine | 20 sec |
| PO-oxidation | 0.02M | t-Butyl-hydrogen peroxide | 600 sec |
| PS-oxidation | 2% | Beaucage reagent/anhy. Acetonitrile | 360 Sec (200 sec, wait +30 sec pulse +130 sec wait |
| Cap A | 5% | 5% Phenoxyacetic anhydride/THF/pyridine | 20 sec |
| Cap B | 10% | 10% N-Methylimidazole/THF | 20 sec |
| Detritylation | 3% TCA | Trichloro Acetic Acid/dichloromethane | 70 sec |

2. Deprotection-I (Nucleobase Deprotection)

After completion of synthesis the controlled pore glass (CPG) was transferred to a screw cap vial or a screw cap RNase free microfuge tube. The oligonucleotide was cleaved from the support with the simultaneous removal of base and phosphate protecting groups with a mixture of ethanolic ammonia [ammonia (28-30%):ethanol (3:1) 1.0 mL] for 15 h at 55° C. The vial was cooled briefly on ice and then the ethanolic ammonia mixture was transferred to a new microfuge tube. The CPG was washed with portions of deionized water (2×0.1 mL). The combined filtrate was then put in dry ice for 10 min dried in a speed vac.

3. Deprotection-II (Removal of 2'-O— TBDMS Group)

The white residue obtained was resuspended in a mixture of triethylamine, triethylamine trihydrofluoride (TEA.3HF ca, 24% HF) and 1-Methyl-2-Pyrrolidinone (NMP) (4:3:7) (400 ul) and heated at 65° C. for 90 min to remove the tert-butyldimethylsilyl (TBDMS) groups at the 2'-position. The reaction was then quenched with isopropoxytrimethylsilane (iPrOMe$_3$Si, 400 ul) and further incubated on the heating block leaving the caps open for 10 min; (This causes the volatile isopropxytrimethylsilylfluoride adduct to vaporize). The residual quenching reagent was removed by drying in a speed vac. 3% Triethylamine in diethyl ether (1.5 ml) was added and the mixture was subjected to centrifugation to afford a pellet of RNA. The supernatant was pipetted out without disturbing the pellet. The pellet was dried in a speed vac. The crude RNA was obtained as a white fluffy material in the microfuge tube.

4. Quantitation of Crude Oligomer or Raw Analysis

Samples were dissolved in deionized water (1.0 mL) and quantitated as follows: Blanking was first performed with water alone (1 mL). A sample of the RNA solution (20 ul) was diluted with water (980 uL) and mixed well in a microfuge tube, then transferred to a cuvette and the absorbance reading was obtained at 260 nm. The crude material was dried down and stored at −20° C.

5. MS Analysis:

Samples of the RNA (0.1 OD) were analyzed using MS.

6. Purification of Oligomers

Polyacrylamide Gel Electrophoresis (PAGE) Purification

The oligonucleotides were purified by vertical slab polyacrylamide gel electrophoresis (PAGE) using an Owl's Separation Systems (Portsmouth, N.H.). Electrophoresis grade acrylamide (40%), N,N'-methylene-bis(acrylamide) (BIS), ammonium persulfate (APS, N,N,N'N'-tetramethylenediamine (TEMED), bromophenol blue (BPB), xylene cyanol (XC) 10×TBE (0.89 M). Trishydroxy-methylaminomethane, borate (pH 8.3), 20 mM disodium ethylenediaminetetraacetate) were from National Diagnostics (Atlanta, Ga.). The 12% Denaturing gel was prepared for purification of oligoribonucleotides. The thickness of the preparative gel was 1.5 mm. Loading buffer was 80% formamide in 10×TBE. After removal of the PAGE glass plates, the gels were covered with Saran Wrap® and placed over a fluorescent TLC plate illuminated by a hand-held UV lamp (Upland, Calif.) for visualization. The desired bands were excised and shaken overnight in water (2 mL) or 0.03 M sodium acetate. The eluent was removed and dried in a speed vac. All biotin conjugated sequences were purified by PAGE.

7. Desalting of Purified Oligomer

The purified dry oligomer was then desalted using Sephadex G-25 M (Amersham Biosciences). The cartridge was conditioned with of deionized water thrice (10 mL each). Finally the purified oligomer dissolved thoroughly in 2.5 mL RNAse free water was applied to the cartridge with very slow drop-wise elution. The salt free oligomer was eluted with deionized water (3.5 ml) directly into a screw cap vial. The purified RNA material was dried down on speed vac and stored at −20° C.

8. Quality Control
(a) Capillary Gel Electrophoresis (CGE)
(b) Electrospray LC/Ms A sample of the oligomer (approx. 0.10 OD) was dissolved in water (50 ul & 100 ml in separate tubes) and then pipetted into special vials for CGE and LC/MS analysis.

9. Analysis of Duplex Activity

Duplexes were tested for activity in the HeLa cell assay described above. Tables 8, 9, 10 and 18 and FIGS. 31-35 provides data and graphs of the activities in HeLa cells for each of the modifications described above.

Example 11

Conjugation of Retinoids to RNA (Table 14)

Conjugation of All-Trans-Retinal to Oligonucleotides (RNA):

Phosphoramidite 104 was synthesized as shown in Scheme B for retinal conjugation to oligonucleotides.

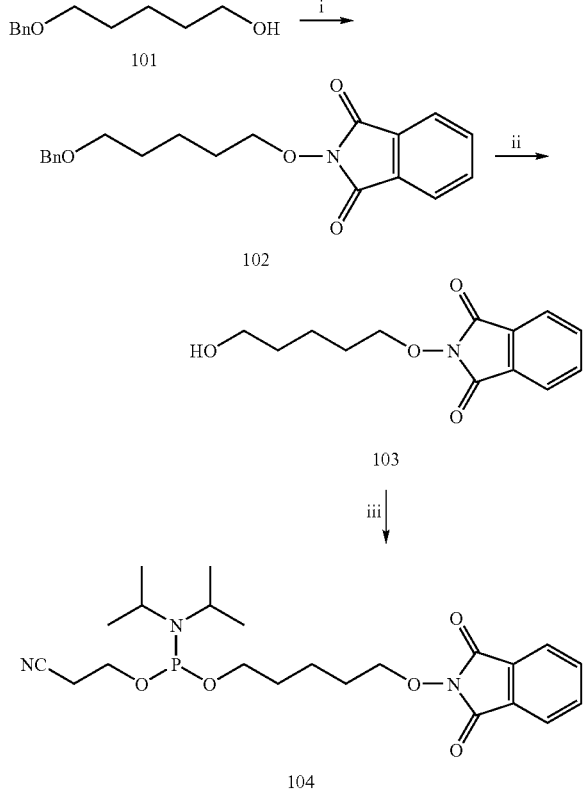

$^a$(i) Ph$_3$P, DIAD, N-hydroxyphthalimide/MeCN;
(ii) H$_2$, Pd——C (10%), 1 atm/ETOAc;
(iii) Phosphitylation Step 1: Compound 102:Monobenzylpentan-1,5-diol (15.70 g, 80.82 mmol), Ph$_3$P (25.43 g, 96.84 mmol) and N-hydroxyphthalimide (116.0 g, 98.08 mmol) were taken in anhydrous CH$_3$CN (100 ml) under argon atm. Neat DIAD (20.0 mL, 103.25 mmol) was added dropwise into the stirring solution over a period of 20 minutes and the stirring was continued for 24 h. The reaction was monitored by TLC. Solvents were removed in vacuo; and the residue was triturated with diethyl ether and filtered. Residue was washed with ether, filtered and combined the filtrate. Hexane was added dropwise into the filtrate until it gave turbidity and subsequently the solution was made homogeneous by adding ether into it. The homogeneous solution was stored at 5° C. for 24 h. Precipitated Ph$_3$PO was filtered off, washed with ether-hexane mixture (1:1). Combined filtrate was evaporated to dryness and the residue was purified by flash silica gel column chromatography (10-15% EtOAc in Hexane) to obtain 24.5 g (89.3%) of compound 102 as a viscous pale yellow oil. $^1$H NMR (400 MHz, CDCl$_3$, 25° C.): 7.84-7.82 (m, 2H); 7.75-7.73 (m, 2H); 7.34-7.33 (m, 4H); 7.29-7.26 (m, 1H); 4.51 (s, 2H); 4.22-4.18 (t, J(H,H)=6.71 Hz, 2H); 3.52-3.48 (t, J(H,H)= 6.4 Hz, 2H); 2.04-1.78 (m, 2H); 1.73-1.56 (m, 4H). $^{13}$C NMR (100 MHz, CDCl$_3$, 25° C.): 163.9, 138.8, 134.6, 129.2, 128.6, 127.8, 127.7, 123.7, 78.6, 73.1, 70.3, 29.6, 28.2, 22.5.

Step 2: Compound 103: Compound 102 (23.5 g, 69.29 mmol) was taken in 100 ml of EtOAc/methanol (1:1). The mixture was degassed and purged with argon, to this 2.4 g of Pd—C (10%-wet Degusa type) was added. The mixture was then hydrogenated overnight, filtered through a celite bed over a sintered funnel. The residue was subsequently passed through a column of silica gel and eluted out using 40% EtOAc in hexane to obtain compound 103 (15.70 g, 90.9%) as a white solid. $^1$H NMR (400 MHz, CDCl$_3$, 25° C.) 7.83-7.81 (bm. 2H); 7.75-7.73 (bm, 2H); 4.23-4.19 (t, J(H,H)=6.4 Hz, 2H); 3.70-3.66 (t, J(H,H)=5.80 Hz, 2H); 1.83-1.79 (m, 2H); 1.67-1.60 (m, 4H). $^{13}$C NMR (100 MHz, CDCl$_3$, 25° C.) □ 163.9, 134.7, 129.1, 123.7, 78.6, 62.7, 32.4, 28.0, 22.0.

Step 3: Compound 104: Compound 103 (5.4 g, 21.67 mmol) and triethylamine (4 ml, 28.69 mmol) were taken in anhydrous EtOAc (30 ml) under argon. 2-Cyanoethyl diisopropylchlorophosphoramidite (5.00 ml, 21.97 mmol) was added to the reaction mixture dropwise. A white precipitate of Et$_3$N.HCl was formed immediately after the addition of the reagent and the reaction was complete in 10 min (monitored by TLC). The precipitate was filtered through a sintered funnel and solvent was removed under reduced pressure. The residue was directly loaded on a silica gel column for purification. Eluted with hexane/EtOAc 9:1 to afford compound 104 as a yellow oil, 8.68 g (89.13%). $^1$H NMR (400 MHz, CDCl$_3$, 25° C.) □ 7.85-7.81 (m, 2H); δ 7.77-7.72 (m, 2H); 4.22-4.19 (t. J(H,H)=6.80 Hz, 2H); 3.91-3.76 (m, 2H); 3.72-3.53 (m, 4H) 2.67-2.63 (t, J(H,H)=6.71 Hz, 2H); 1.86-1.78 (m, 2H); 1.73-1.66 (m, 2H); 1.62-1.56 (m, 2H); 1.19-1.16 (m, 12H). $^{31}$P NMR (162 MHz, CDCl$_3$, 25° C.) δ 145.09. $^{13}$C NMR (100 MHz, CDCl$_3$, 25° C.) δ 163.9, 134.7, 129.2, 123.7, 117.9, 78.6, 64.0, 63.4, 58.7, 58.5, 43.2, 43.1, 31.1, 31.0, 28.1, 24.9, 24.8, 24.7, 22.3, 20.6, 20.5.

Step 4: Conjugation of all-trans-retinal to Oligonucleotide: All-trans-retinal was conjugated to oligonucleotide as shown in the Scheme C. Compound 104 was coupled to solid bound oligonucleotide 105 under standard solid phase oligonucleotide synthesis conditions to obtain compound 106. Phthalimido protecting group on compound 106 was selectively removed by treating with hydrazinium hydrate as reported by Salo et al. (*Bioconjugate Chem.* 1999, 10, 815) to obtain compound 107. Treatment of compound 107 with all-trans-retinal under dark condition gave compound 108 as reported in the literature (*Bioconjugate Chem.* 1999, 10, 815). Standard RNA oligonucleotide deprotection and purification under dark yielded the desired oligonucleotide-retinal conjugate 109. Compound 109 was also obtained from compound 110 as shown in Scheme C. Complete deprotection and purification of compound 106 yielded an unbound free oligonucleotide 110 which was subsequently reacted with all-trans-retinal to afford the desired compound 109.

Scheme C: Conjugation of all trans-retinal to oligonucleotides

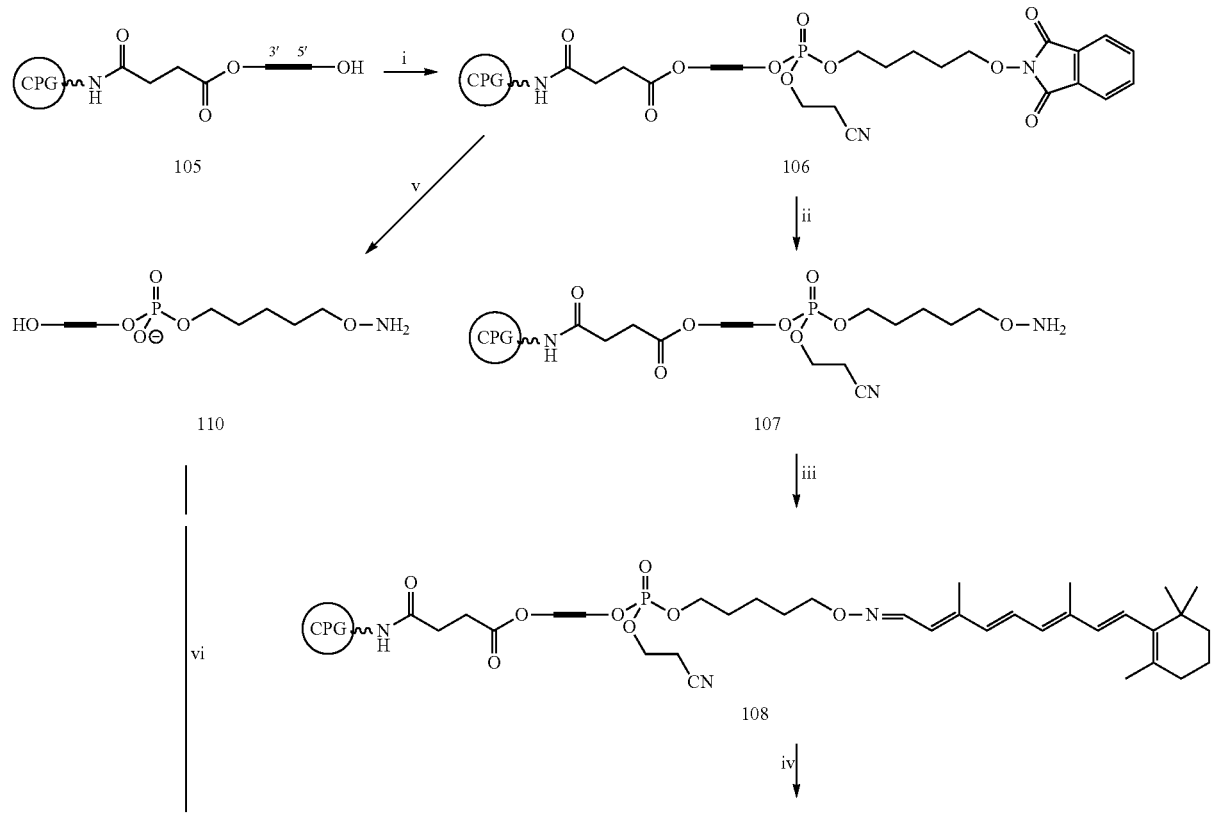

-continued

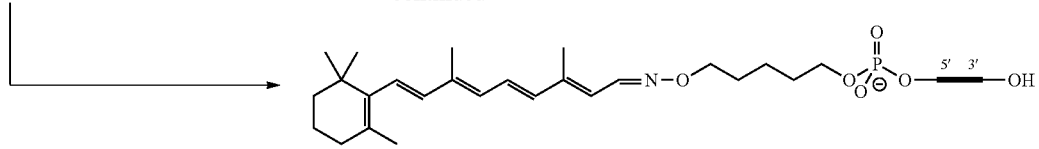

109 a (i) Phosphoramidite 104, (standard oligonucleotide synthesis cycle);
(ii) Hydrazinium hydrat/Py/AcOH (0.124/4/7);
(iii) all-trans-retinal in DMF or MeCN;
(iv) Oligonucleotide (RNA) deprotection (MeNH$_2$, TEA.3HF) and purification;
(v) Oligonucleotide (RNA) deprotection (MeNH$_2$, TEA.3HF) and purification;
  DMSO—H$_2$O
(vi) all-trans-retinal in Step 4.1. Oligonucleotide Synthesis:

All oligonucleotides except AL-3166 were synthesized on an ABI 490 DNA synthesizer. Commercially available controlled pore glass solid supports (dT-CPG and U-CPG, 500 Å) and RNA phosphoramidites with standard protecting groups, 5'-O-dimethoxytrityl-N-6-benzoyl-2'-t-butyldimethylsilyl-adenosine-3'-O—N,N'-diisopropyl-2-cyanoethylphosphoramidite, 5'-O-dimethoxytrityl-N4-acetyl-2'-t-butyldimethylsilyl-cytidine-3'-O—N,N'-diisopropyl-2-cyanoethylphosphoramidite, 5'-O-dimethoxytrityl-N2-isobutyryl-2'-t-butyldimethylsilyl-guanosine-3'-O—N,N'-diisopropyl-2-cyanoethylphosphoramidite, and 5'-O-dimethoxytrityl-2'-t-butyldimethylsilyl-uridine-3'-O—N,N'-diisopropyl-2-cyanoethylphosphoramidite were used for the oligonucleotide synthesis. All phosphoramidites were used at a concentration of 0.15M in acetonitrile (CH$_3$CN). Coupling time of 10 minutes was used. The activator was 5-ethyl thiotetrazole (0.25 M), for the PO-oxidation Iodine/Water/Pyridine was used.

Sequence AL-3166 was synthesized on the AKTAoligopilot synthesizer. All phosphoramidites were used at a concentration of 0.2M in acetonitrile (CH$_3$CN) except for guanosine which was used at 0.2M concentration in 10% THF/acetonitrile (v/v). Coupling/recycling time of 16 minutes was used. The activator was 5-ethyl thiotetrazole (0.75 M), for the PO-oxidation Iodine/Water/Pyridine was used and for the PS-oxidation PADS (2%) in 2,6-lutidine/ACN (1:1 v/v) was used.

The aminooxy-linker phosphoramidite was synthesized as described above and used at a concentration of 0.15 M in acetonitrile. Coupling time for the aminooxy-linker phosphoramidite was 15 minutes. For all sequences, coupling of the aminooxy-linker phosphoramidite was carried out on the ABI 390 DNA synthesizer.

Step 4.2. Cleavage of the Phthalimido-Protecting Group from the Aminoxy-Linker Oligonucleotides After coupling of the aminooxy-linker, the CPG was treated with 2.5 ml of 0.5M hydrazinium acetate in pyridine (0.16/4/2 hydrazine anhydrous, pyridine, acetic acid) using the dual syringe method. Every 5 minutes the syringes were pushed back and forth to get new solution on the CPG. After the hydarzinium acetate treatment, the CPG was washed with 2×5 ml of pyridine followed by 3×5 ml of acetonitrile. Flushing with dry argon for 30 seconds then dried CPG.

Step 4.3. On Support Conjugation with the Aldehydes

The 1-pyrene-carboxaldehyde and the all-trans-retinal were from Aldrich and used at concentrations of 0.5M in DMF. The 4-keto-retinol was used at a concentration of 0.13M in DMF. The CPG from above was added to the aldehyde solutions. Conjugation was carried out overnight (~16 hrs) at room temperature. After the reaction was complete, the CPG was rinsed with DMF followed by acetonitrile and air dried for 10-15 minutes. For sequence AL-3213, the conjugation with both all-trans-retinal and 1-pyrene-carboxaldehyde was also carried out in acetonitrile. In the case of 1-pyrene-carboxaldehyde, the aldehyde did not fully dissolved at 0.5 M and the solution was used as is without filtration to get rid of the undissolved aldehyde.

Step 4.4. Deprotection-I (Nucleobase Deprotection) of on Support Conjugated Oligonucleotides For on support retinal conjugated oligonucleotides, the support was transferred to a 5 ml tube (VWR). The oligonucleotide was cleaved from the support with simultaneous deprotection of base and phosphate groups with 1 mL of 40% aq. methylamine 15 mins at 65° C. The tube was cooled briefly on ice and then the methylamine was filtered into a new 15 ml tube. The CPG was washed with 3×1 mL portions of DMSO.

Step 4.5. Deprotection-II (Removal of 2' TBDMS Group) of on Support Conjugated Oligonucleotides To the above mixture was added 1.5 ml of triethylamine trihydrofluoride (TREAT-HF) and heated at 60° C. for 15 minutes to remove the tert-butyldimethylsilyl (TBDMS) groups at the 2' position. The reaction was then quenched with 5.5 ml of 50 mM sodium acetate (pH 5.5) and stored in freezer until purification.

Step 4.6. After Deprotection Conjugation with Aldehydes

Conjugation with the aldehydes (1-pyrene-carboxaldehyde and all-trans-retinal) after deprotection of the aminooxy-linker oligonucleotides was also carried out as an alternative conjugation strategy.

Step 4.7. Deprotection-I (Nucleobase Deprotection) for after Deprotection Conjugation The support was transferred to a 2 ml screw cap tube. The oligonucleotide was cleaved from the support with simultaneous deprotection of base and phosphate groups with 0.5 mL of 40% aq. methylamine 15 mins at 65° C. The tube was cooled briefly on ice and then the methylamine was filtered into a new 15 ml tube. The CPG was washed with 2×0.5 mL portions of 50% acetonitrile/water. The mixture was then frozen on dry ice and dried under vacuum on a speed vac.

Step 4.8. Deprotection-II (Removal of 2' TBDMS Group) for After Deprotection Conjugation The dried residue was resuspended in 0.5 ml of triethylamine trihydrofluoride (TEA.3HF) and heated at 60° C. for 15 minutes to remove the tert-butyldimethylsilyl (TBDMS) groups at the 2' position. The reaction mixture was then cooled to room temperature and RNA precipitated with 2 ml of dry methanol and dried under vacuum on a speed vac. The sample was then dissolved in 2 ml of water and kept frozen in freezer till further analysis.

Step 4.9. Quantitation of Crude Oligomer or Raw Analysis

For all samples, a 1 µl, a 10 µl or 30 µl aliqoute was diluted with 999 µl, 990 µl or 970 µl of deionised nuclease free water (1.0 mL) and absorbance reading obtained at 260 nm.

Step 4.10. Purification of Conjugated Oligomers (a) Cude LC/MS Analysis

The crude oligomers were first analyzed by LC/MS, to look at the presence and abundance of the expected final product.

(b) Reverse-Phase Purification

The conjugated samples were purified by reverse-phase HPLC on an RPC-Source 15 column (21.5×1 cm). The buffer system was: A=20 mM sodium acetate in 10% ACN, pH 8.5 and B=20 mM sodium acetate in 70% ACN, pH 8.5, with a flow rate of 5.0 mL/min, and wavelengths 260 and 375. The fractions containing the full-length oligonucleotides were then individually desalted.

Step 4.11. Desalting of Purified Oligonucleotides

The purified oligonucleotide fractions were desalted using the PD-10 Sephadex G-25 columns. First the columns were equilibrated with 25-30 ml of water. The samples were then applied in a volume of 2.5 ml. The samples were then eluted in salt-free fraction of 3.5 ml. The desalted fractions were combined together and kept frozen till needed.

Step 4.12. Capillary Gel Electrophoresis (CGE), Ion-Exchange HPLC (IEX) and Electrospray LC/Ms Approximately 0.3 OD of desalted oligonucleotides were diluted in water to 300 µl and then pipetted in special vials for CGE, IEX and LC/MS analysis.

Step 5 Conjugation of All-Trans-Retinal to 3'-End of Oligonucleotides (RNA):

Phoshoramidite 116 for 5'-conjugation and CPG support 115 for 3'-conjugation of retinoids were synthesized as shown in the Scheme D. The CPG support 115 is used for 3' conjugation of retinoids to oligonucleotides

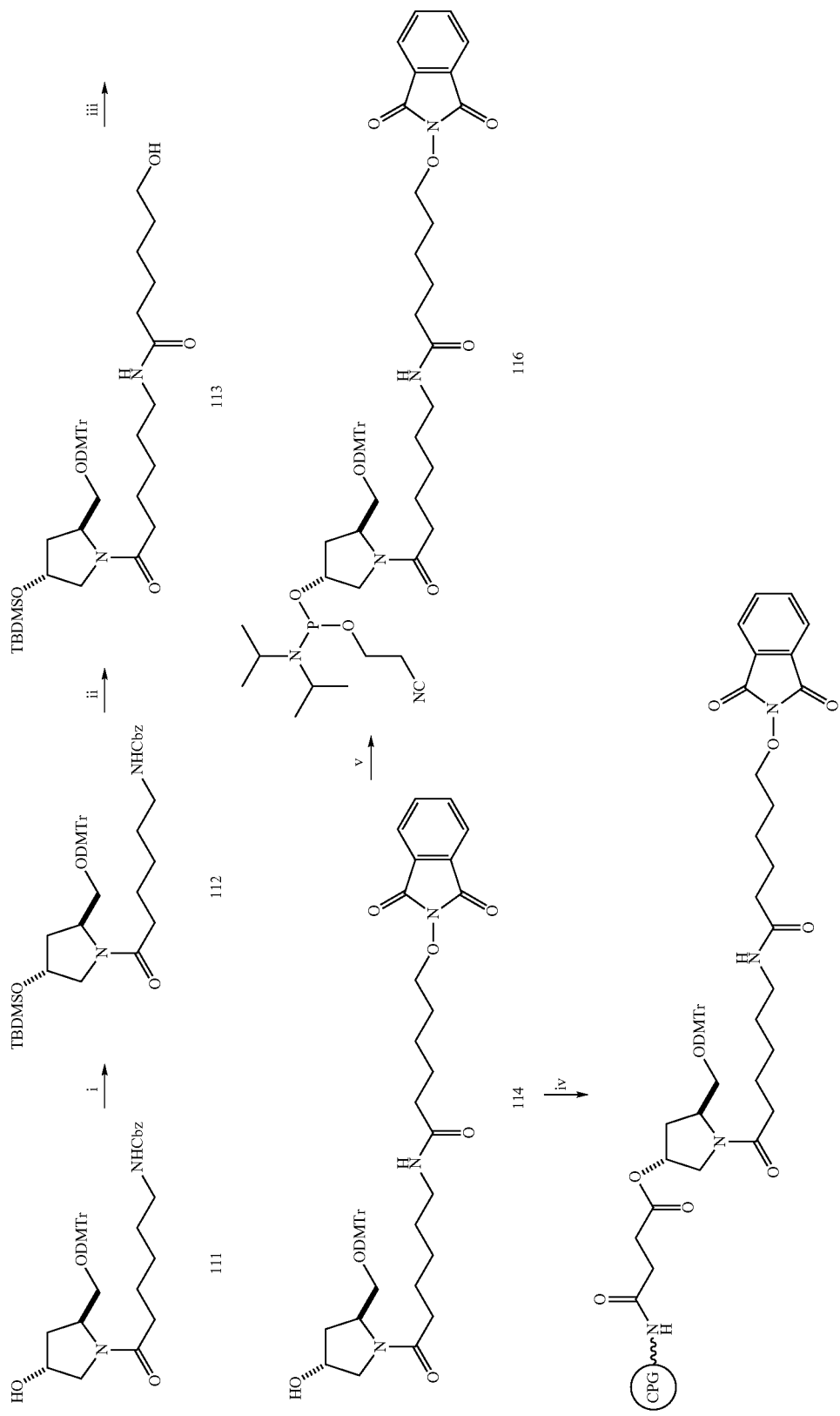

Scheme D<sup>a</sup>. Synthesis of Post-synthetic conjugation building blocks for retinal conjugation-oxime approach 2 for 3' and 5' conjugation.

<sup>a</sup> (i) TBDMS-Cl, Imidazole/Py, rt;
(ii) (a) H<sub>2</sub>, Pd—C (10%)/EtOAc-MeOH, 4 h and (b) □-Caprolactone, TEA, 55° C., 24 h;
(iii) TEA.3HF/THF;
(iv) (a) Succinic anhydride, DMAP/EDC, 24h and (b) DTNP, Ph<sub>3</sub>P, DMAP followed by addition of lcaa CPG;
(v) Phosphitylation Step 5.1: Compound 112: Compound 111 (120.0 g, 30.01 mmol) was stirred with TBDMS-Cl (5.43 g, 36.02 mmol) in the presence of imidazole (7.5 g, 110.16 mmol) in anhydrous pyridine (100 mL) overnight. After removing pyridine, the product was extracted into ethyl acetate (300 mL), washed with aqueous sodium bicarbonate, followed by standard workup. Residue obtained was subjected to flash silica gel column chromatography using 1% methanol in dichloromethane as eluent to afford compound 112 as a pale white solid (24.4 g, qunat. $^1$H NMR (500 MHz, [D$_6$]DMSO, 25° C.): ☐ 7.33-7.13 (bm, 15H, accounted for 14H after D$_2$O exchange); 6.87-6.82 (bm, 4H); 5.01 (s, 0.2H, rotamer minor); 4.99 (s, 1.8H, rotamer major), 4.68-4.64 (m, 0.72 H, major rotamer); 4.14-4.07 (bm, 1H), 3.72 (s, 7H), 3.38-3.36 (m, 0.6H, rotamer minor); 3.26-3.21 (m, 1.4H, rotamer major); 3.08-3.07 (m, 0.3H, rotamer, minor); 2.99-2.89 (m, 2.7H, rotamer, major); 2.22-2.12 (m, 2H), 2.04-1.78 (m, 2H); 1.48-1.23 (m, 6H), 0.84, 0.82 (s, 9H, rotamers major and minor); 0.05 (d, J(H,H)=1.5 Hz, 4.3H, rotamer major); 0.03-0.02 (d, J(H,H)=5.5 Hz, 1.7H).

Step 5.2: Compound 113: Compound 112 (9.4 g, 14.54 mmol) was suspended in 15 mL of β-caprolactone and 10 mL of TEA was added into the suspension. The reaction mixture was stirred under argon at 55° C. bath temperature for 24 h. Completion of the reaction was monitored by TLC analysis. TEA was removed form the reaction mixture in vacuo and 150 mL of dichloromethane-hexane (2:1 mixture) was added into the residue. The homogeneous solution thus obtained was directly loaded on a column of silica gel and eluted with dichloromethane-hexane (2:1) followed by neat dichloromethane. Elution of the silica column with 4% methanol in dichloromethane afforded the desired compound 113 as a white solid (8.73 g, 78.9%). $^1$H NMR (400 MHz, [D$_6$]DMSO, 25° C.) δ7.72-7.68 (bm, 1H, exchangeable with D$_2$O); 7.33-7.16 (m, 9H); 6.88-6.84 (m, 4H); 4.68-4.62 (m, 0.8H); 4.57-4.52 (m, 0.2H); 4.34-4.31 (t, J(H,H)=5.18 Hz, 1H, exchangeable with D$_2$O); 4.14-4.08 (bm, 1H); 3.74-3.67 (m, 7H); 3.39-3.32 (m, 3.3H); 3.25-3.21 (m, 1.7H); 3.09-2.88 (m, 4H)

6. Analysis of Duplex Activity

Figure 38:
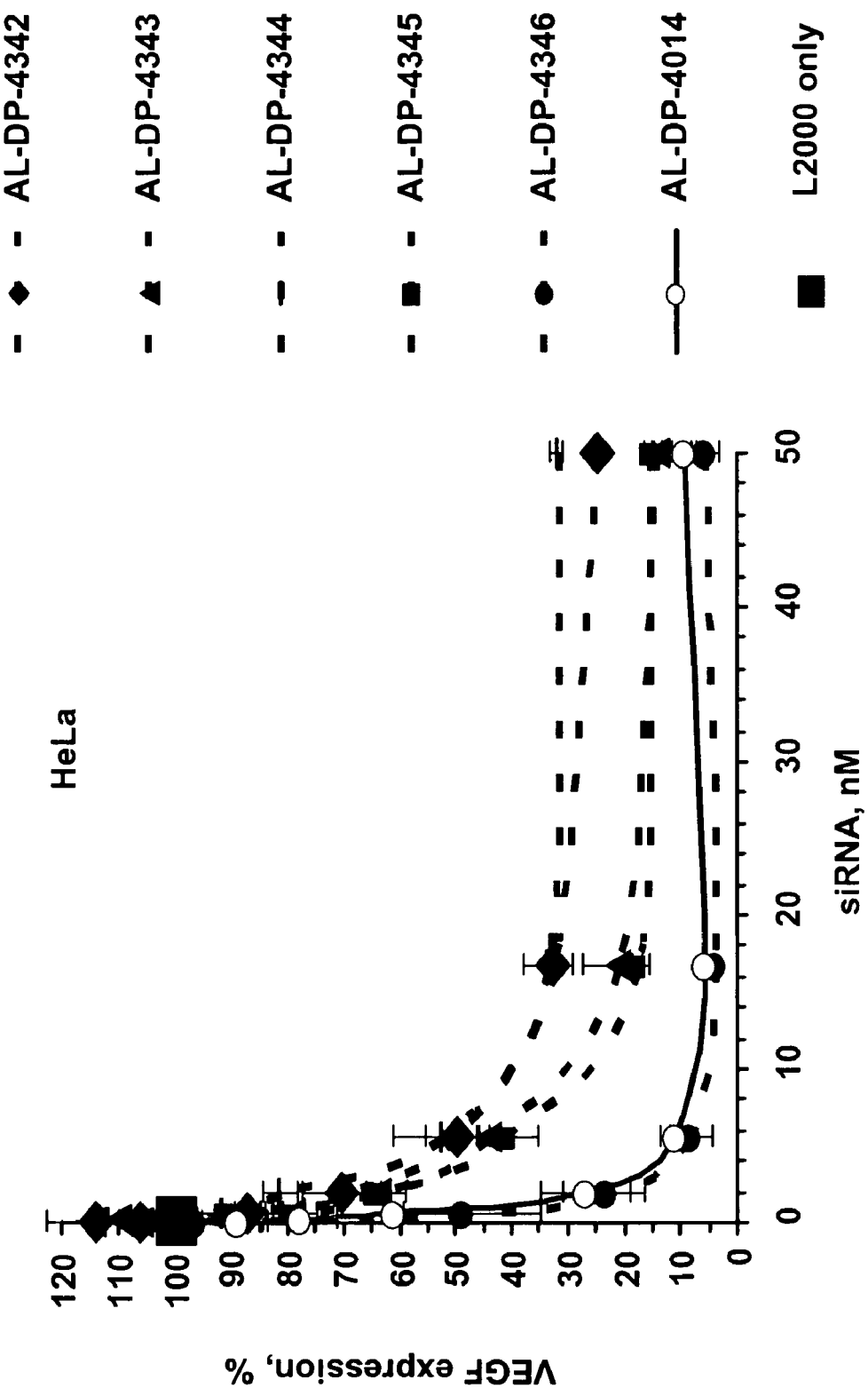
FIG. 38 is a graph of silencing activity of 2'-arafluoro-2' deoxy-nucleoside modified siRNAs in vitro in HeLa cells (Table 14).
Figure 39:
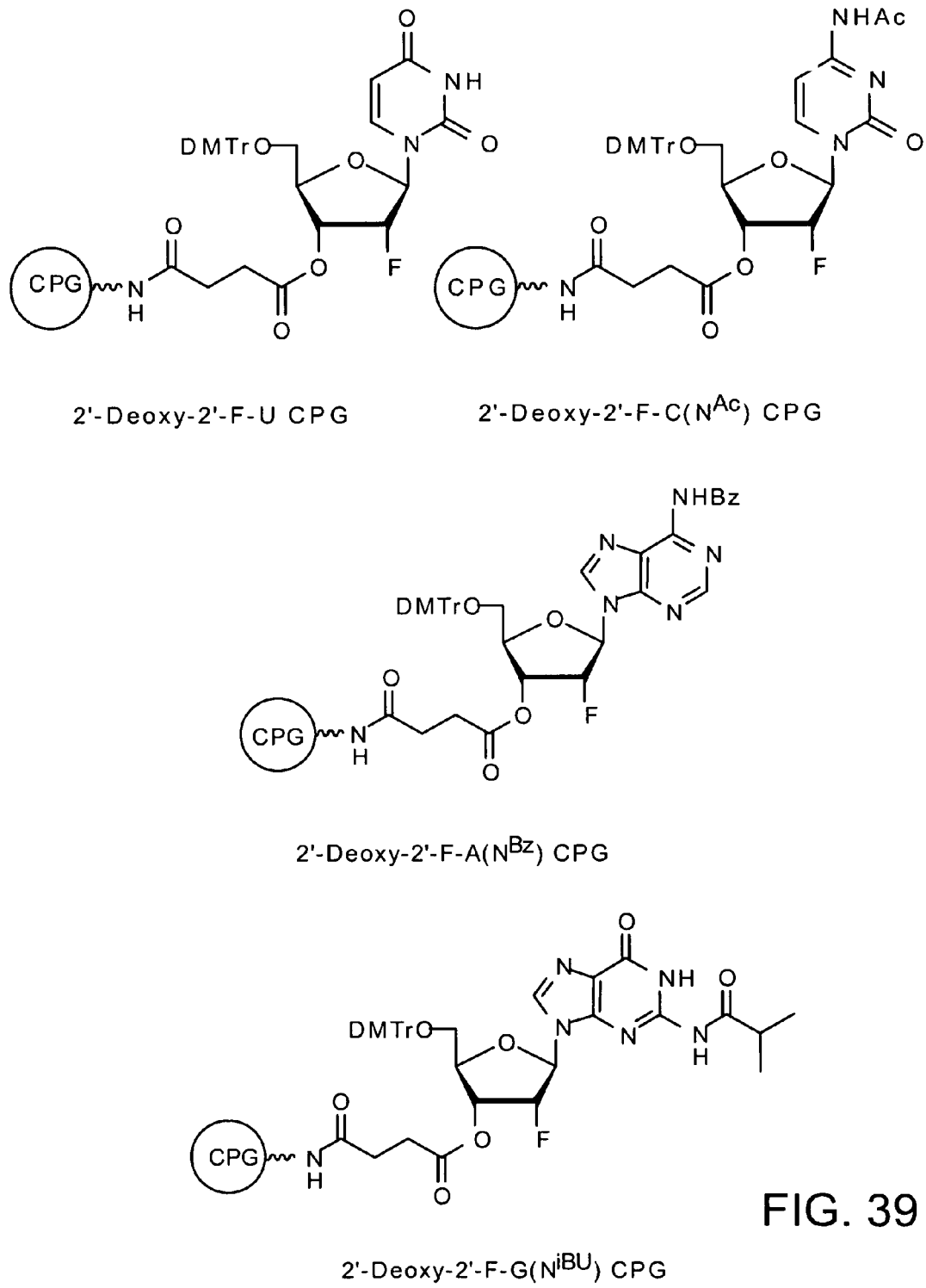
Figure 40:
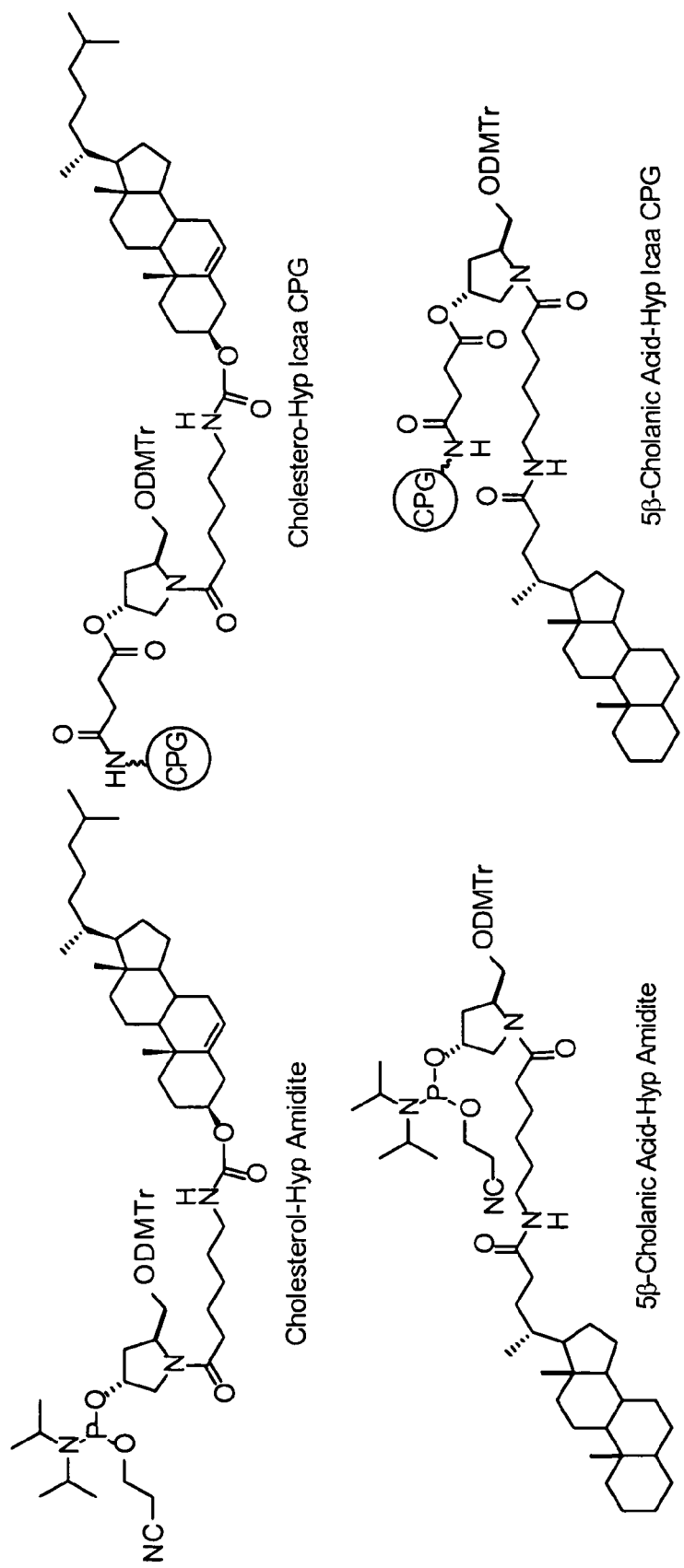
FIG. 40 Cholesterol and 5β-cholanic (or cholanic) acid conjugate building blocks for conjugation to oligonucleotides. These building blocks were used for syntheses of selected sequences listed in Table 8.

Duplexes were tested for activity in the HeLa cell assay described above. Table 14 and FIG. 38 provides data and a graph of the activities in HeLa cells for each of the modifications described above.

Example 12

Conjugation of Polyethylene Glycol to siRNA (Table 12)

Amino Linker Oligonucleotides for Peg Conjugation

General. Ion exchange preparative chromatography was performed on TSKgel-SuperQ-5PW (Tosoh). Ion exchange analytical chromatography was performed on a DNAPac Pa100 (Dionex). Electron spray ionization mass spectra were recorded with an Agilent 1100 MSD-SL.

HPLC Techniques. The RNA was analyzed by ion-exchange chromatography (column, DNAPac Pa100, 4×250 mm, analytical), heated to 30° C., flow rate 1.5 mL min$^{-1}$, buffer A=0.020M Na$_2$HPO$_4$ in 10% CH$_3$CN, pH 11; buffer B=buffer A+1 M NaBr in 10% CH$_3$CN, pH 11, linear gradient from 0 to 75% in 53 min. The LC/ESI-MS conditions were as follows: column XTerra C8 (2.1×30 mm, 2.5 μm), linear gradient from 5 to 35% in 2 min and from 35 to 70% in 30.5 min, flow rate 0.200 mL min$^{-1}$, buffer A=400 mM HFIP/16.3 mM TEA in H$_2$O, buffer B=100% methanol. The RNA was purified by ion-exchange chromatography (5 cm in-house packed column, TSKgel-SuperQ-5PW, 20 μm), heated to 75° C., flow rate 50 mL min$^{-1}$, buffer A=0.020M Na$_2$HPO$_4$ in 10% CH$_3$CN, pH 8.5; buffer B=buffer A+1 M NaBr in 10% CH$_3$CN, pH 8.5, linear gradient from 20 to 55% in 120 min.

RNA synthesis. The protected RNA was assembled on an AKTA Oligo Pilot 100 on a 100-150 μmol scale using custom in-house support and phosphoramidite chemistry. Phosphoramidites were used as 0.2 mol L$^{-1}$ solutions in dry CH$_3$CN, with a 900 s coupling time and the manufacturer's recommended synthesis protocols were used. After synthesis, the support-bound RNA was treated with aqueous CH$_3$NH$_2$ (40%) for 90 minutes at 45° C., cooled, filtered and washed with DMSO (3×40 mL). The filtrate was then treated with TEA.3HF (60 mL) for 60 minutes at 40° C., and quenched with aq. NaOAc (0.05M, pH 5.5, 200 mL). The synthesis was followed by analytical ion-exchange HPLC, preparative HPLC, then desalting on Sephadex G-25.

Step 1. Oligonucleotide Synthesis:

A general conjugation approach is shown in the Scheme E.

All oligonucleotides were synthesized on an AKTAoligopilot synthesizer. Commercially available controlled pore glass solid support (dT-CPG, 500 Å) or the phthalimido-hydroxy-prolinol solid support and RNA phosphoramidites with standard protecting groups, 5'-O-dimethoxytrityl-N6-benzoyl-2'-t-butyldimethylsilyl-adenosine-3'-O—N,N'-diisopropyl-2-cyanoethylphosphoramidite, 5'-O-dimethoxytrityl-N4-acetyl-2'-t-butyldimethylsilyl-cytidine-3'-O—N,N'-diisopropyl-2-cyanoethylphosphoramidite, 5'-O-dimethoxytrityl-N2-isobutryl-2'-t-butyldimethylsilyl-guanosine-3'-O—N,N'-diisopropyl-2-cyanoethylphosphoramidite, and 5'-O-dimethoxytrityl-2'-t-butyldimethylsilyl-uridine-3'-O—N,N'-diisopropyl-2-cyanoethylphosphoramidite were used for the oligonucleotide synthesis. All phosphoramidites were used at a concentration of 0.2M in acetonitrile (CH$_3$CN) except for guanosine which was used at 0.2M concentration in 10% THF/acetonitrile (v/v). Coupling/recycling time of 16 minutes was used. The activator was 5-ethyl thiotetrazole (0.75M), for the PO-oxidation Iodine/Water/Pyridine was used and for the PS-oxidation PADS (2%) in 2,6-lutidine/ACN (1:1 v/v) was used. The amino-linker phosphoramidite was synthesized and used at a concentration of 0.2M in acetonitrile. Coupling/recycling time for the amino-linker phosphoramidite was 16 minutes.

Scheme E$^a$: Pegylation of RNA Oligonucleotides

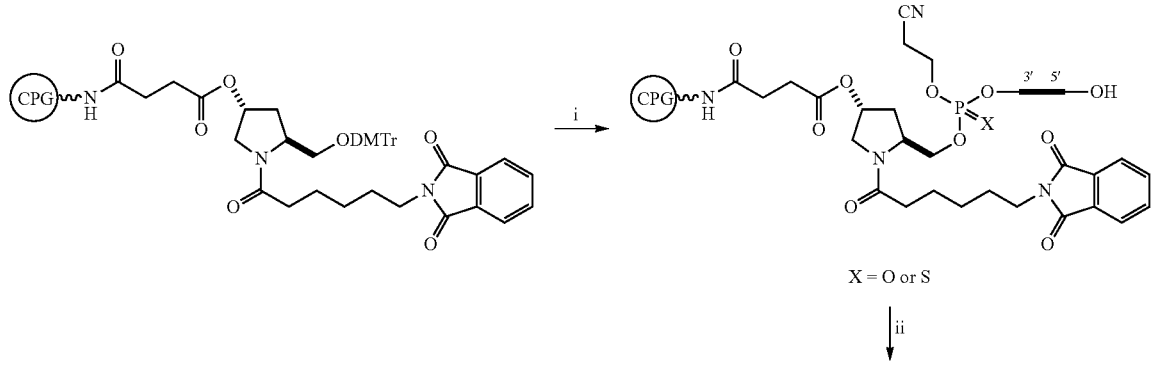

X = O or S

-continued

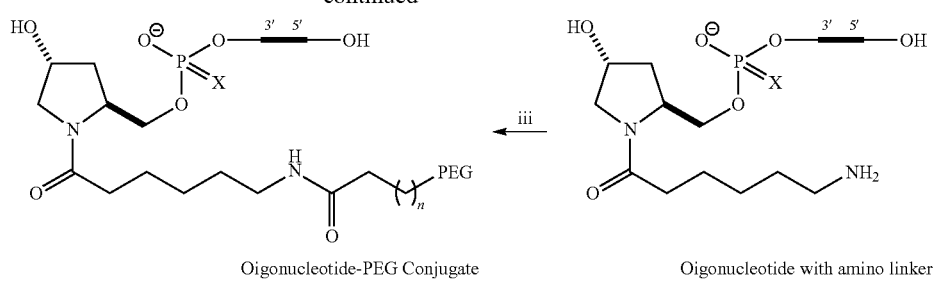

Oigonucleotide-PEG Conjugate   Oigonucleotide with amino linker a (i) Solid phase Oligonucleotide synthesis;
(ii) Deprotection and purification;
(iii) PEG-NHS ester, NaHCO$_3$, pH 8.1, 1 h.

Step 2. Deprotection-I (Nucleobase Deprotection)

After completion of synthesis, the support was transferred to a 100 ml glass bottle. The oligonucleotide was cleaved from the support with simultaneous deprotection of base and phosphate groups with 40 mL of a 40% aq. methyl amine 90 mins at 45° C. The bottle was cooled briefly on ice and then the methylamine was filtered into a new 500 ml bottle. The CPG was washed with 3×40 mL portions of DMSO. The mixture was then cooled on dry ice.

Step 3. Deprotection-II (Removal of 2' TBDMS Group)

To the above mixture was added 60 ml triethylamine trihydrofluoride (TREAT-HF) and heated at 40° C. for 60 minutes to remove the tert-butyldimethylsilyl (TBDMS) groups at the 2' position. The reaction was then quenched with 220 ml of 50 mM sodium acetate (pH 5.5) and stored in freezer until purification.

Step 4. Quantitation of Crude Oligomer or Raw Analysis

For all samples, a 10 µl aliqoute was diluted with 990 µl of deionised nuclease free water (1.0 mL) and absorbance reading obtained at 260 nm.

Step 5. Purification of Oligomers (a) HPLC Purification

The crude oligomers were first analyzed by HPLC (Dionex PA 100). The buffer system was: A=20 mM phosphate pH 11, B=20 mM phosphate, 1.8 M NaBr, pH 11, flow rate 1.0 mL/min, and wavelength 260-280 nm. Injections of 5-15 µl were done for each sample. The samples were purified by HPLC on an TSK-Gel SuperQ-5PW (20) column (17.3×5 cm). The buffer system was: A=20 mM phosphate in 10% ACN, pH 8.5 and B=20 mM phosphate, 1.0 M NaBr in 10% ACN, pH 8.5, with a flow rate of 50.0 mL/min, and wavelength 260 and 294. The fractions containing the fulllength oligonucleotides were then pooled together, evaporated and reconstituted to ~100 ml with deionised water.

Step 6. Desalting of Purified Oligomer

The purified oligonucleotides were desalted on an AKTA Explorer (Amersham Biosciences) using Sephadex G-25 column. First column was washed with water at a flow rate of 25 ml/min for 20-30 min. The sample was then applied in 25 ml fractions. The eluted salt-free fractions were combined together, dried down and reconstituted in 50 ml of RNase free water.

Step 7. Capillary Gel Electrophoresis (CGE) and Electrospray LC/Ms

Approximately 0.15 OD of desalted oligonucleotides were diluted in water to 150 µl and then pipetted in special vials for CGE and LC/MS analysis.

Step 8. PEG Conjugation.

A) Initial reaction conditions. The purified and desalted RNA was lyophilized. RNA (1 mg) was dissolved in aq.NaHCO$_3$ (0.1M, 200 µL, pH 8.1) and DMF (200 µL each). 5 K (13 equivalents, 10 mg) or 20 KPEG (3.4 equivalents, 10 mg) was added directly to reaction vial and vortexed thoroughly. The reaction continued overnight at 4° C., and was followed by analytical ion-exchange HPLC. When the reaction reached >85% completion, it was quenched with aq. NaOAc (0.05M, pH 5.5) until the pH was ~7.

B) Borate buffer conjugation. The purified and desalted RNA was lyophilized. A sample of RNA (1 mg) was dissolved in sodium borate buffer (200 µL, 0.05M, pH10). 5 KPEG (3 mg, 4.5 equivalents Sunbright ME-50HS, NOF Corp.) was dissolved in CH$_3$CN (200 µL). The RNA solution was added to the PEG solution and vortexed thoroughly. The reaction continued for one hour at room temperature, and was followed by analytical ion-exchange HPLC. When reaction reached >85% completion, it was quenched with aq. NaOAc (0.05M, pH 5.5) until the pH was ~7.

C) PEG linker (AS and HS) comparison. A sample of RNA (1 mg) was dissolved in aq. NaHCO$_3$ (0.1M, 200 µL, pH 8.1) and DMF (200 µL). 5 KPEG (13.5 eq, 10 mg, Sunbright ME-50HS or Sunbright ME-50AS, NOF Corp.) was added directly to the reaction vial and vortexed thoroughly. The reaction continued overnight at 4° C., and was followed by analytical ion-exchange HPLC. When the reaction reached >85% completion, it was quenched with aq. NaOAc (0.05M, pH 5.5) until the pH was ~7.

D) Final optimized PEG conjugation. The purified and desalted RNA was lyophilized. A sample of RNA (50 mg) was dissolved in aq. NaHCO$_3$ (0.1M, 2 mL pH 8.1) and DMF (1 mL). 20 KPEG (approximately 2.7 eq, 400-520 mg Sunbright ME-200HS, different amounts for different sequences within this range) was dissolved in CH$_3$CN (2 mL). The RNA solution was added to the PEG solution and vortexed thoroughly. H$_2$O (250 mL) was added to the reaction to decrease turbidity. The reaction continued for one hour at room temperature, and was followed by analytical ion-exchange HPLC. When the reaction reached >85% completion, it was quenched with aq. NaOAc (0.05M, pH 5.5) until the pH was ~7.

Step 9. Analysis of Duplex Activity

Duplexes were tested for activity in the HeLa cell assay described above. Table 12 and FIG. 45 provide data and graphs of the activities in HeLa cells for each of the modifications described above.

Example 13

Synthesis of Oligonucleotides Containing the Ribo-Difluorotoluoyl (DFT) Nucleoside (Table 13)

The RNA molecules were synthesized on a 394 ABI machine using the standard cycle written by the manufacturer with modifications to a few wait steps. The solid support was 500 Å dT CPG (2 umole). The monomers were either RNA phosphoramidites or the ribo-difluorotoluoyl amidite. All had standard protecting groups and were used at concentrations of 0.15 M in acetonitrile ($CH_3CN$) unless otherwise stated. Specifically the phosphoramidites were 5'-O-Dimethoxytrityl-$N^6$-benzoyl-2'-O-tbutyldimethylsilyl-adenosine-3'-O-(β-cyanoethyl-N,N'-diisopropyl) phosphoramidite, 5'-O-Dimethoxytrityl-$N^2$-isobutyryl-2'-O-tbutyldimethylsilyl-guanosine-3'-O-(β-cyanoethyl-N,N'-diisopropyl) phosphoramidite, 5'-O-Dimethoxytrityl-$N^4$-acetyl-2'-O-tbutyldimethylsilyl-cytidine-3'-O-(β-cyanoethyl-N,N'-diisopropyl)phosphoramidite, and 5'-O-Dimethoxytrityl-2'-O-tbutyldimethylsilyl-uridine-3'-O—)β-cyanoethyl-N,N'-diisopropyl)phosphoramidite, 5'-O-Dimethoxytrityl-difluorotoluoyl O-tbutyldimethylsilyl-3'-O-(β-cyanoethyl-N,N'-diisopropyl)phosphoramidite (0.12 M). The coupling times were 7 min for all RNA monomers and 10 min for the DFT monomer. Details of the other reagents are as follows: Activator: 5-ethylthio-1H-tetrazole (0.25M), Cap A: 5% acetic anhydride/THF/pyridine, Cap B: 10% N-methylimidazole/THF; phosphate oxidation involved 0.02M $I_2$/THF/$H_2O$. Detritylation was achieved with 3% TCA/dichloromethane. The DMT protecting group was removed after the last step of the cycle.

After completion of synthesis the CPG was transferred to a screw cap, sterile microfuge tube. The oligonucleotide was cleaved and the base and phosphate groups were simultaneously deprotected with 1.0 mL of a mixture of ethanolic ammonia (1:3) for 16 hours at 55° C. The tube was cooled briefly on ice and then the solution was transferred to a 5 mL centrifuge tube; this was followed by washing three times with 0.25 mL of 50% acetonitrile. The tubes were cooled at −80° C. for 15 min, before drying in a lyophilizer.

The white residue obtained was resuspended in 200 uL of triethylamine trihydrofluoride and heated at 65° C. for 1.5 h to remove the TBDMS groups at the 2'-position. The oligonucleotides were then precipitated in dry methanol (400 uL). The liquid was removed carefully to yield a pellet at the bottom of the tube. Residual methanol was removed in the speed vacuum to give a white fluffy material. Samples were dissolved in 1 mL RNase free water and quantitated by measuring the absorbance at 260 nm. This crude material was stored at −20° C.

The crude oligonucleotides were analyzed and purified by 20% polyacrylamide denaturing gels. The purified dry oligonucleotides were then desalted using Sephadex G25M.

Duplexes were tested for activity in the HeLa cell assay described above. Table 13 and FIG. 46 provide data and graphs of the activities in HeLa cells for each of the modifications described above.

Example 14

Synthesis of RNA Modified with 2'-Ara-Fluoro-2'-Deoxy-Nucleosides (Table 14)

The chimeric RNA molecules were synthesized on a 394 ABI machine using the standard cycle written by the manufacturer with modifications to a few wait steps. The solid support was 500 Å dT CPG (2 μmole). The monomers were either RNA phosphoramidites, or 2'-arafluoro-2'-deoxy (2' ara F) phosphoramidites. All monomers had standard protecting groups and were used at concentrations of 0.15 M in acetonitrile ($CH_3CN$) unless otherwise stated. Specifically the RNA phosphoramidites were 5'-O-Dimethoxytrityl-$N^6$-benzoyl-2'-O-tbutyldimethylsilyl-adenosine-3'-O-(α-cyanoethyl-N,N'-diisopropyl) phosphoramidite, 5'-O-Dimethoxytrityl-$N^2$-isobutyryl-2'-O-tbutyldimethylsilyl-guanosine-3'-O-(β-cyanoethyl-N,N'-diisopropyl)phosphoramidite, 5'-O-Dimethoxytrityl-$N^4$-acetyl-2'-O-tbutyldimethylsilyl-cytidine-3'-O-(β-cyanoethyl-N,N'-diisopropyl) phosphoramidite, and 5'-O-Dimethoxytrityl-2'-O-tbutyldimethylsilyl-uridine-3'-O—(O-cyanoethyl-N,N'-diisopropyl)phosphoramidite; the 2' ara F phosphoramidites were 5'-O-Dimethoxytrityl-$N^4$-benzoyl-2'-arafluoro-2'-deoxy-cytidine-3'-O-(β-cyanoethyl-N,N'-diisopropyl)phosphoramidite, and 5'-O-Dimethoxytrityl-2'-arafluoro-2'-deoxy-uridine-3'-O-(β-cyanoethyl-N,N'-diisopropyl) phosphoramidite, and 5'-O-Dimethoxytrityl-2'-arafluoro-thymidine-3'-O-(β-cyanoethyl-N,N'-diisopropyl) phosphoramidite. The coupling times were 10 min for all monomers. Details of the other reagents are as follows: Activator: 5-ethylthio-1H-tetrazole (0.25M), Cap A: 5% acetic anhydride/THF/pyridine, Cap B: 10% N-methylimidazole/THF; phosphate oxidation involved 0.02 M $I_2$/THF/$H_2O$. Detritylation was achieved with 3% TCA/dichloromethane. The final DMT protecting group was removed after the last cycle.

After completion of synthesis the CPG was transferred to a screw cap, sterile microfuge tube. The oligonucleotide was cleaved and the base and phosphate groups were simultaneously deprotected with 1.0 mL of a mixture of ethanolic ammonia conc (1:3) for 5 hours at 55° C. The tube was cooled briefly on ice and then the solution was transferred to a 5 mL centrifuge tube; this was followed by washing three times with 0.25 mL of 50% acetonitrile. The tubes were cooled at −80° C. for 15 min, before drying in a lyophilizer.

The white residue obtained was resuspended in 200 μL of triethylamine trihydrofluoride and heated at 65° C. for 1.5 h to remove the TBDMS groups at the 2'-OH position. The oligonucleotides were then precipitated in dry methanol (400 μL). The liquid was removed carefully to yield a pellet at the bottom of the tube. Residual methanol was removed in the speed vacuum to give a white fluffy material. Samples were dissolved in 1 mL RNase free water and quantitated by measuring the absorbance at 260 nm. This crude material was stored at −20° C.

The crude oligonucleotides were analyzed and purified by 20% polyacrylamide denaturing gels. The purified dry oligonucleotides were then desalted using Sephadex G25M (Amersham Biosciences).

Figure 47:
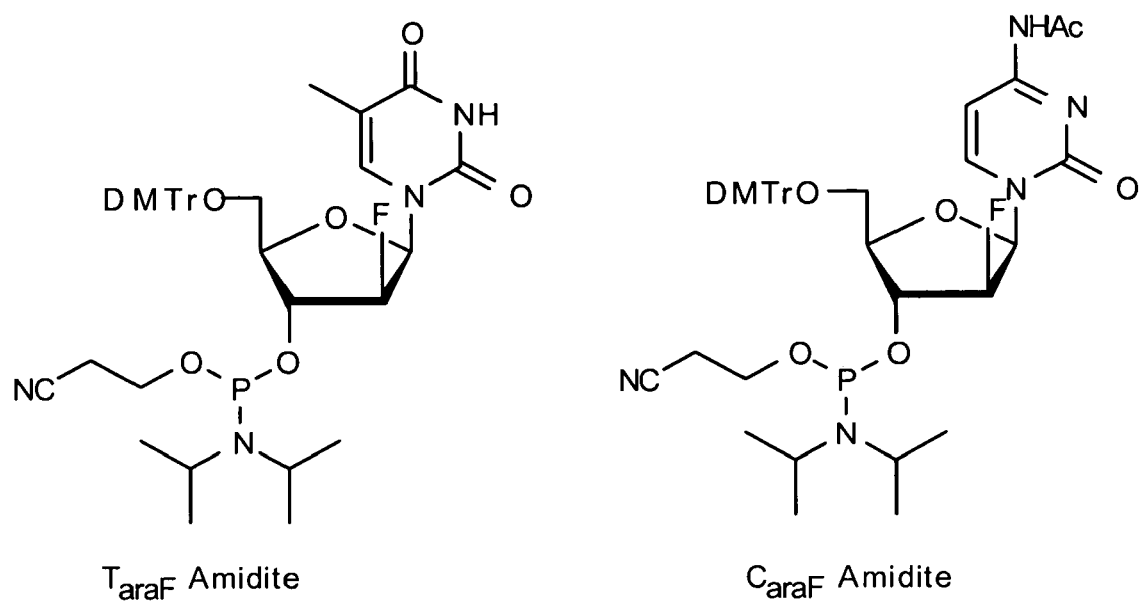

Duplexes were tested for activity in the HeLa cell assay described above. Table 14 and FIG. 47 provide data and graphs of the activities in HeLa cells for each of the modifications described above.

Example 15

Deprotection of Methylphosphonate Modified siRNAs (Table 15)

Deprotection Step 1:

After completion of the synthesis, the controlled pore glass (CPG) was transferred to a screw cap vial. A solution (0.5 ml) consisting of Acetonitrile/Ethanol/$NH_4OH$ (45:45:10) was added to the support. The vial was sealed and left at room temperature for 30 min. Ethylenediamine (0.5 mL) was added to the vial and left at room temperature for an additional 6 hours. The supernatant was decanted and the support was washed twice with 1:1 acetonitrile/water (0.5 mL). The combined supernatant was diluted with water (15 mL). The pH was adjusted to 7.0 with 6 M HCl in AcCN/H$_2$O (1:9). The sample was desalted using a Sep-pak C$_{18}$ cartridge and then dried in a speed vac.

Deprotection Step 2 (Removal of 2'-O— TBDMS Group)

The white residue obtained was resuspended in a mixture of triethylamine, triethylamine trihydrofluoride (TEA.3HF ca, 24% HF) and 1-Methyl-2-Pyrrolidinone (NMP) (4:3:7) (400 ul) and heated at 65° C. for 90 min to remove the tert-butyldimethylsilyl (TBDMS) groups at the 2'-position. The reaction was then quenched with isopropoxytrimethylsilane (iPrOMe$_3$Si, 400 ul) and further incubated on the heating block leaving the caps open for 10 min; (This causes the volatile isopropxytrimethylsilylfluoride adduct to vaporize). The residual quenching reagent was removed by drying in a speed vac. 3% Triethylamine in diethyl ether (1.5 ml) was added and the mixture was subjected to centrifugation to afford a pellet of RNA. The supernatant was pipetted out without disturbing the pellet. The pellet was dried in a speed vac. The crude RNA was obtained as a white fluffy material in the microfuge tube.

Purification:

All methylphosphonate modified sequences were purified by PAGE

Analysis of Duplex Activity

Figure 48:
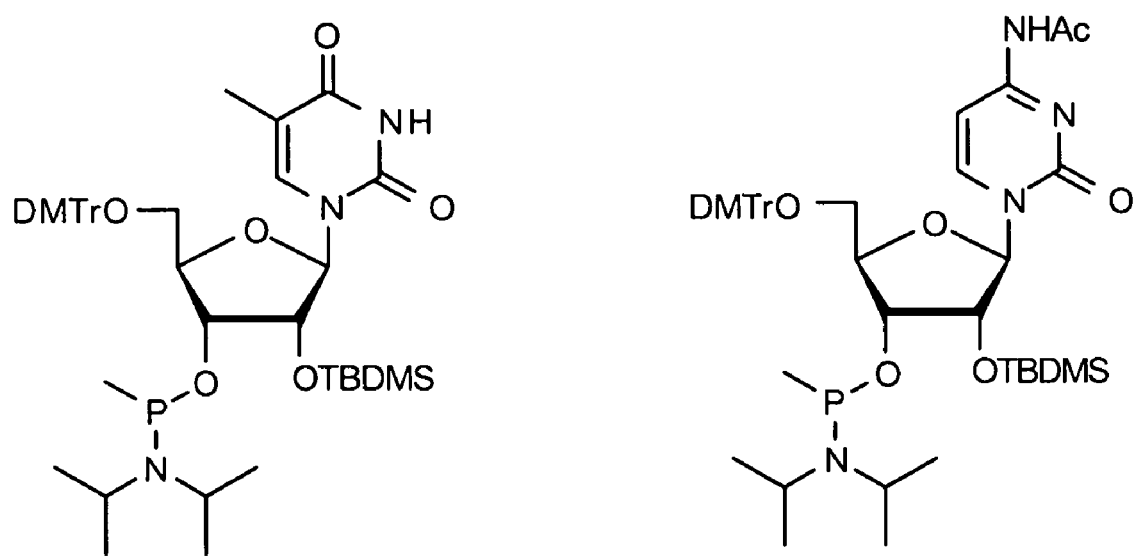
FIG. 48 P-methylphosphonamidite of ribo $^{5Me}U$ and ribo $C(N^{4c})$. These building blocks were used for syntheses of selected sequences listed in Table 15.

Duplexes were tested for activity in the HeLa cell assay described above. Table 15 and FIG. 48 provide dat and graphs of the activities in HeLa cells for each of the modifications described above.

Example 16

AL-DP-4409 Inhibits VEGF Protein and mRNA Expression in a Dose-Dependent Manner

The ability of AL-DP-4409 to inhibit VEGF was assessed in vitro by transient transfection of siRNAs into two human (HeLa and ARPE-19) cell lines and one rat (RPE-J) cell line. AL-DP-4409 activity was compared to its unmodified "parent" siRNA (AL-DP-4094), its mismatch control (AL-DP-4409 MM), a control unrelated siRNA directed towards luciferase (AL-DP-3015), and an active VEGF siRNA reported in the literature (hVEFG5 or Cand5 (Reich et al. *Molec. Vision* 9:210-6, 2003)).

Methods: siRNA: ALN-VEG01 is a chemically modified (one 3' PS per strand) siRNA that targets all VEGF-A spliced isoforms across multiple species (human, rat, mouse, etc.). ALN-VEG01 mM is a mismatch siRNA identical in sequence and chemistry to ALN-VEG01 with the exception of 5 mismatched base pairs. AL-DP-4094 represents the unmodified "parent" siRNA of ALN-VEG01 and contains the identical sequence to ALN-VEG01 but with no chemical modifications. Control irrelevant siRNA targeting luciferase was also utilized. Sequences of the siRNAs are listed below (s indicates phosphorothioate modification and mismatches are shown in bold):

```
5' GCACAUAGGAGAGAUGAGCUsU 3'        SEQ ID NO:671

3' GsUCGUGUAUCCUCUCUACUCGA A 5'     SEQ ID NO:939

5' GCACAUUGGACAGUUGUGGUsU 3'        SEQ ID NO:995

3' GsUCGUGUAACCUGUCAACACCA A 5'     SEQ ID NO:996
```

Mismatches to AL-DP-4409 are shown as bold and underlined.

```
5' GCACAUAGGAGAGAUGAGCUU 3'         SEQ ID NO:608

3' GUCGUGUAUCCUCUCUACUCGAA 5'       SEQ ID NO:609

5' GAACUGUGUGUGAGAGGUCCU 3'         SEQ ID NO:830

3' CGCUUGACACACACUCUCCAGGA 5'       SEQ ID NO:831
```

Transfection: Human epithelial cervical adenocarcinoma (HeLa, ATCC, Cat#CCL-2.2) or retinal pigment epithelial cells—human (ARPE-19, ATCC, Manassas, Va., Cat#CRL-2302) or rat (RPE-J, ATCC, Manassas, Va., Cat#CRL-2240), were plated in 96-well plates (8,000-10,000 cells/well) in 100 µl 10% fetal bovine serum in Dulbecco's Modified Eagle Medium (DMEM, Gibco, Cat#11995-065). When the cells reached approximately 50% confluence (~20 hours later) they were transfected with serial three-fold dilutions of siRNA starting at 10 nM. 0.4 µl of transfection reagent Lipofectamine™ 2000 (Invitrogen Corporation, Carlsbad, Calif., Cat#11668-027) was used per well and transfections were performed according to the manufacturer's protocol. Namely, the siRNA: Lipofectamine™ 2000 complexes were prepared as follows. The appropriate amount of siRNA was diluted in Opti-MEM I Reduced Serum Medium (Gibco, Cat#31985-062). The Lipofectamine™ 2000 was mixed gently before use, then for each well of a 96 well plate 0.4 µl was diluted in 25 µl of Opti-MEM I Reduced Serum Medium, mixed gently and incubated for 5 minutes at room temperature. After the 5 minute incubation, 1 µl of the diluted siRNA was combined with the diluted Lipofectamine™ 2000 (total volume is 26.4 µl). The complex was mixed gently and incubated for 20 minutes at room temperature to allow the siRNA:Lipofectamine™ 2000 complexes to form. Then 100 µl of 10% fetal bovine serum in DMEM was added to each of the siRNA:Lipofectamine™ 2000 complexes and mixed gently by rocking the plate back and forth. 100 µl of the above mixture was added to each well containing the cells and the plates with human HeLa and ARPE-19 cells were incubated at 37° C. (with rat RPE-J cells at ~33° C.) in a CO$_2$ incubator for 24 hours, then the culture medium was removed and 100 µl of fresh 10% fetal bovine serum in DMEM was added.

Following the medium change at time points indicated for each experiment, conditioned medium was collected to measure VEGF protein levels and cells were lysed to measure VEGF mRNA levels.

VEGF protein quantification in conditioned medium: Human or rat VEGF ELISA was performed, using the Quantikine human or rat VEGF ELISA kit (R&D Systems, Inc. Minneapolis, Minn.). These kits contain the basic components required for the development of sandwich ELISAs to measure natural and recombinant human or rat VEGF in cell culture supernatants.

VEGF mRNA quantification in cell lysates: Cells were assayed for VEGF mRNA silencing using QuantiGene Discover Kit (Genospectra, Fremont, Calif., Cat#QG-000-010) following the manufacturer's protocol.

Figure 51:
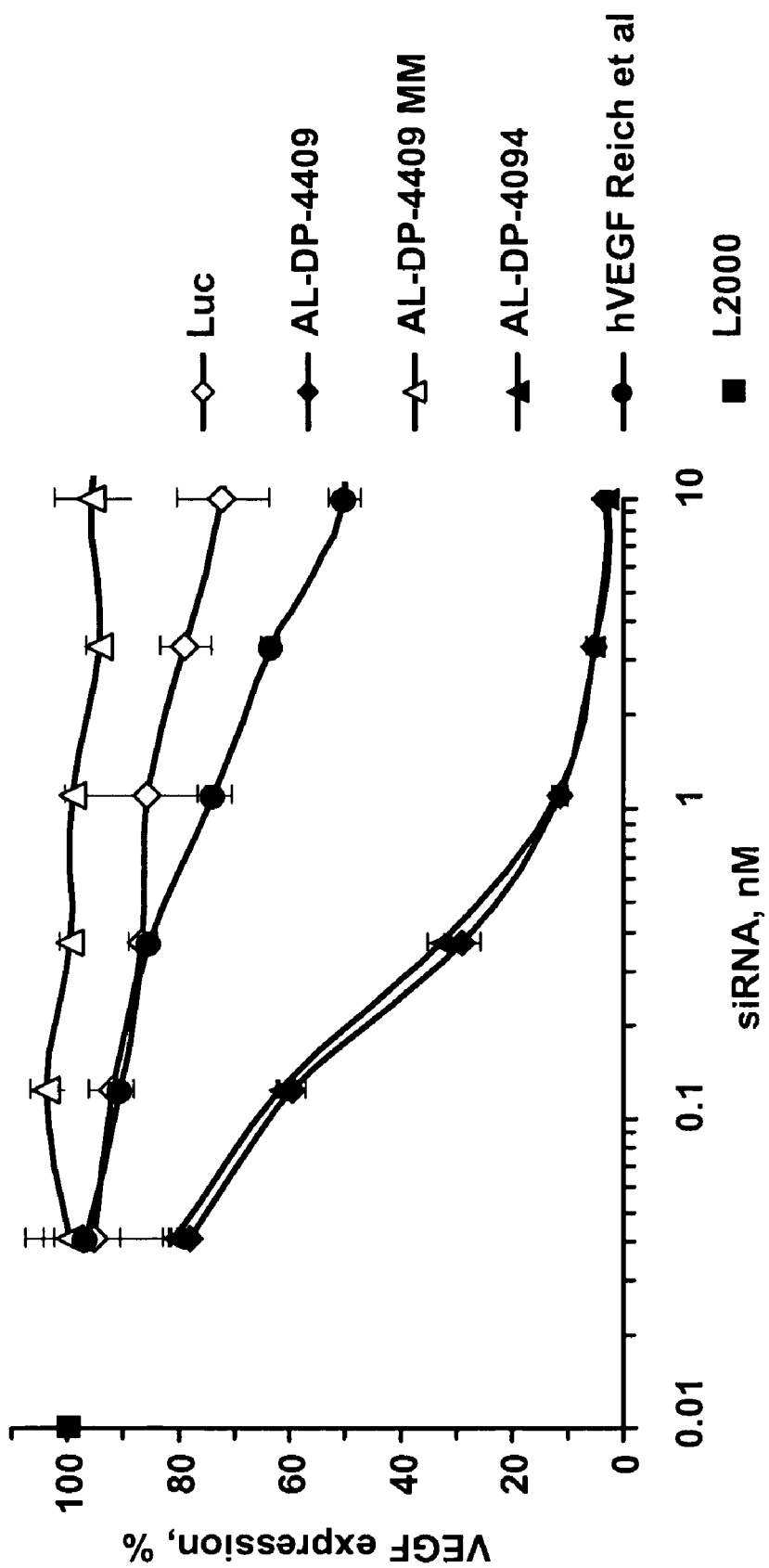
FIG. 51 is a graphical representation of VEGF protein levels in HeLa cells following administration of the indicated double-stranded RNAs.
Figure 52:
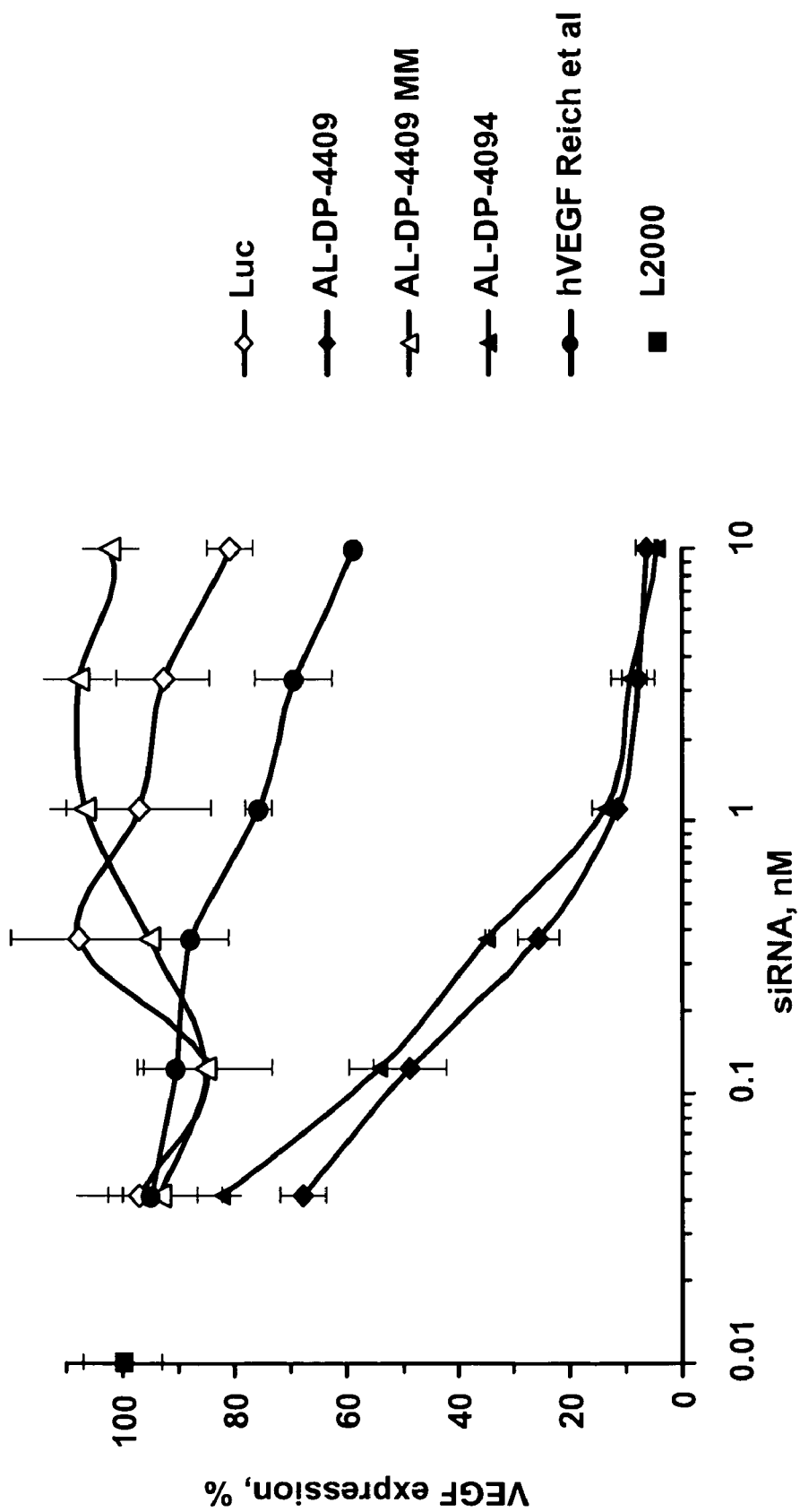
FIG. 52 is a graphical representation of VEGF protein levels in ARPE-19 cells following administration of the indicated double-stranded RNAs.

Results: FIGS. 51 and 52 demonstrate that in human HeLa (2 days post-transfection) and ARPE-19 (5 days post-transfection) cell lines, respectively, both AL-DP-4409 and its originally synthesized batch (AL-DP-4094), but not Luciferase (AL-DP-3015) or AL-DP-4409 MM, inhibited VEGF protein expression in a dose-dependent manner. In both cell lines, AL-DP-4409 exhibited more than 90% protein reduction with an IC50 of 100-200 nM, while VEGF5 (Cand5) exhibited less than 50% protein reduction with an IC50 higher than 1 µM.

Figure 53:
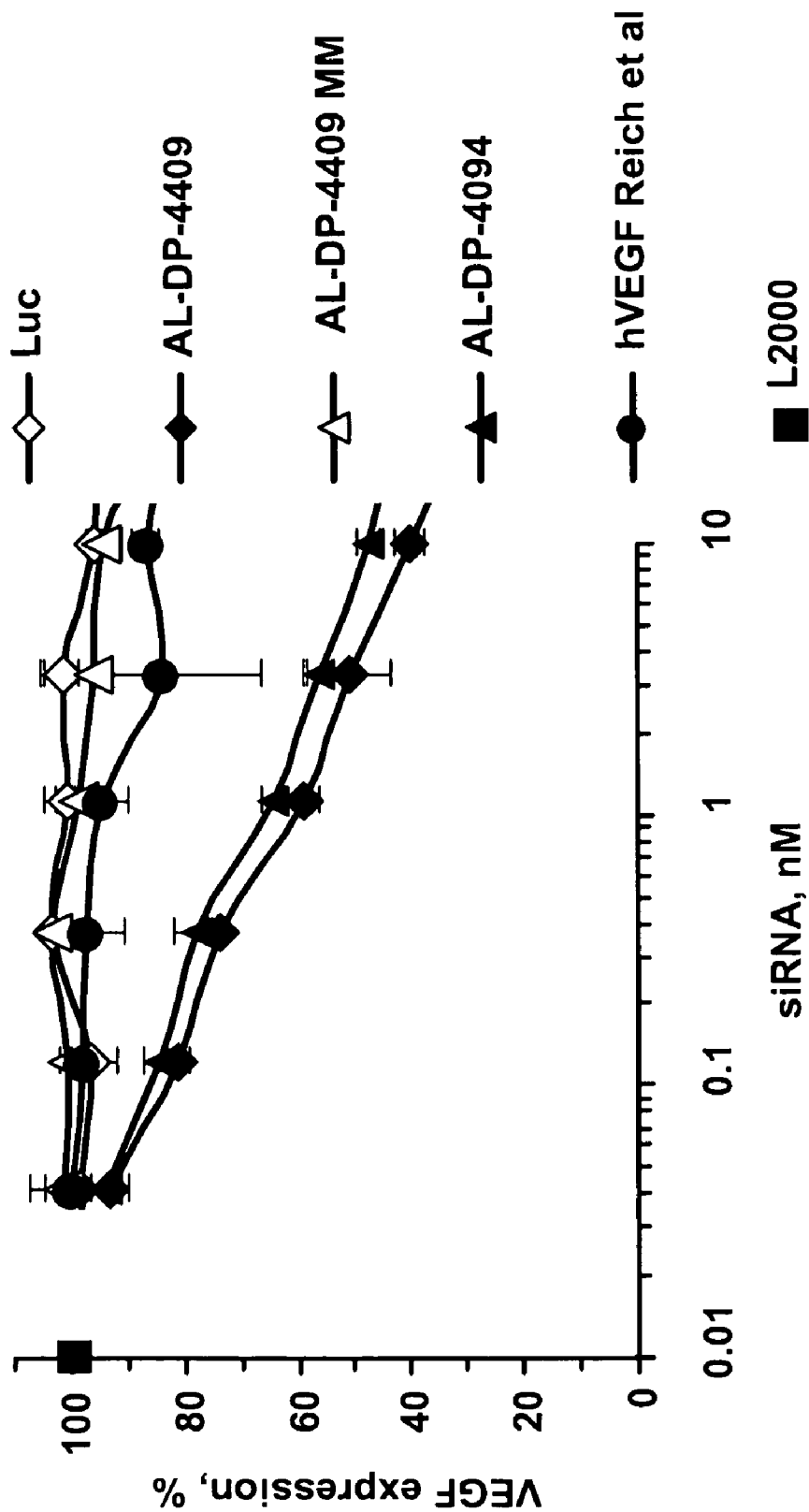
FIG. 53 is a graphical representation of VEGF protein levels in rat RPE-J cells following administration of the indicated double-stranded RNAs.

FIG. 53 demonstrates that in rat RPE-J cell line (7 days post-transfection) both AL-DP-4409 and its originally synthesized unmodified batch (AL-DP-4094), but not Luciferase (AL-DP-3015) or AL-DP-4409 MM, inhibited VEGF protein expression in a dose-dependent manner and exhibited more than 90% protein reduction with an IC50 of 100-200 nM. VEGF5 (Cand5) does not crossreact with rat and did not show any activity.

Figure 54:
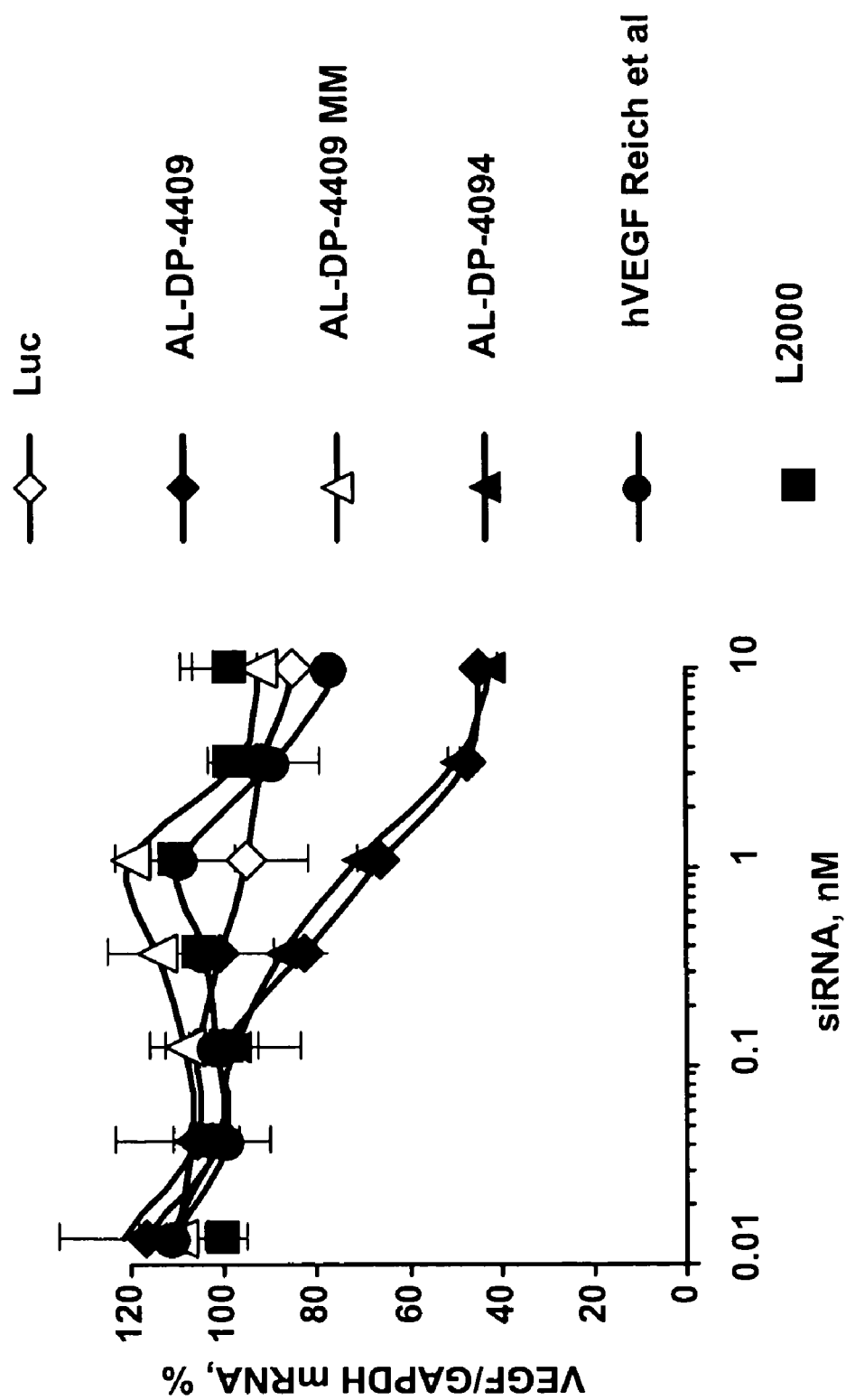
FIG. 54 is a graphical representation of VEGF mRNA levels in HeLa cells following administration of the indicated double-stranded RNAs. Expression levels were measured according to the ratio of VEGF mRNA to a GAPDH control mRNA.

On the mRNA level (FIG. 54), in HeLa cells, 2 days post-transfection, 60% inhibition of VEGF mRNA was observed in a human HeLa cell line with AL-DP-4409 and its unmodified "parent" siRNA (AL-DP-4094), but not with Luciferase (AL-DP-3015) or AL-DP-4409 MM controls. The IC50 of AL-DP-4409 was around 200 nM.

Figure 55:
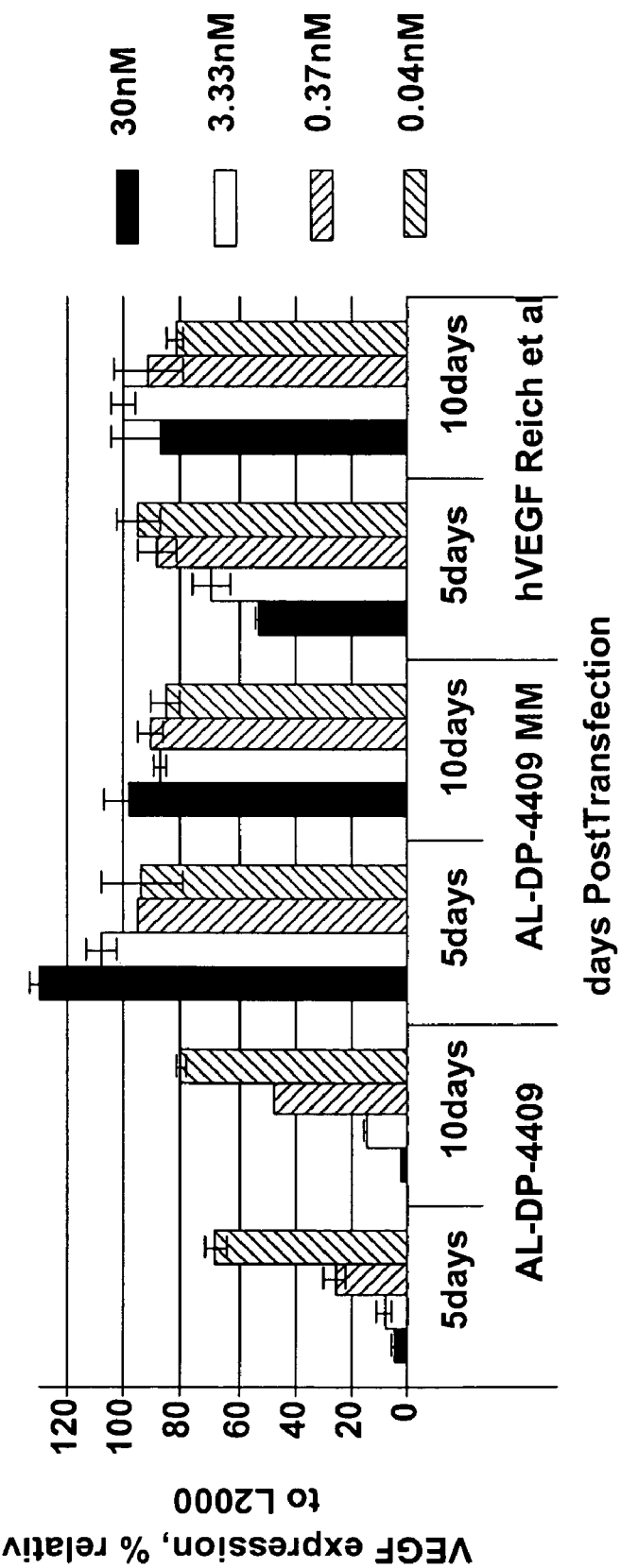
FIG. 55 is a bar graph illustrating the effect of varying concentrations of the indicated double-stranded RNAs at 5 and 10 days post-transfection.

As shown in FIG. 55, VEGF protein inhibition by AL-DP-4409 was more than 90% in human ARPE-19 cells, and this inhibition lasted for at least 10 days when cells were treated with 30 nM AL-DP-4409. At doses less than 0.4 nM, protein inhibition was maintained at more than 50% for at least 10 days.

Example 17

An siRNA Directed Against VEGF Decreased Retinal Neovascularization

Rodent models of retinopathy of prematurity (ROP), also known as oxygen-induced retinopathy, have been utilized to assess the efficacy of a variety of anti-angiogenic compounds in the context of ocular neovascularization.

Materials and Methods: Newborn rats were exposed to oxygen concentration alternating between 50% and 10% every 24 hrs from birth through day 14. Alternating oxygen concentrations were used because the 50%/10% regimen produces a severe, reproducible, predictable and measurable retinal vascular response. At day 14, the rats were removed to room air where they remained until day 20. Therapeutic agents, including siRNA, were administered intravitreally in PBS (5 μl/injection) at the time of removal from the exposure chamber (day 14). Following exposure to room air, the retinal vasculature responds to the "relative" low oxygen concentration of room air as a hypoxic condition, thus resulting in the rapid upregulation of angiogenic molecules, such as VEGF, which promote growth of new blood vessels. Neovascularization was quantitatively assessed using computer-assisted image analysis of flat mount retinal preparations stained with ADPase. In addition, the area of retina containing intraretinal vessels was measured to determine the effect, if any, of various treatments on the normal retinal vasculature. Neovascularization data are expressed as mean neovascular area $(mm^2)$+/−SE and normal retinal vasculature data are expressed as % vascular area (+/−SE). Scheffe's post-hoc analysis was employed to identify significant differences in both neovascular area and normal vascular area.

Figure 56:
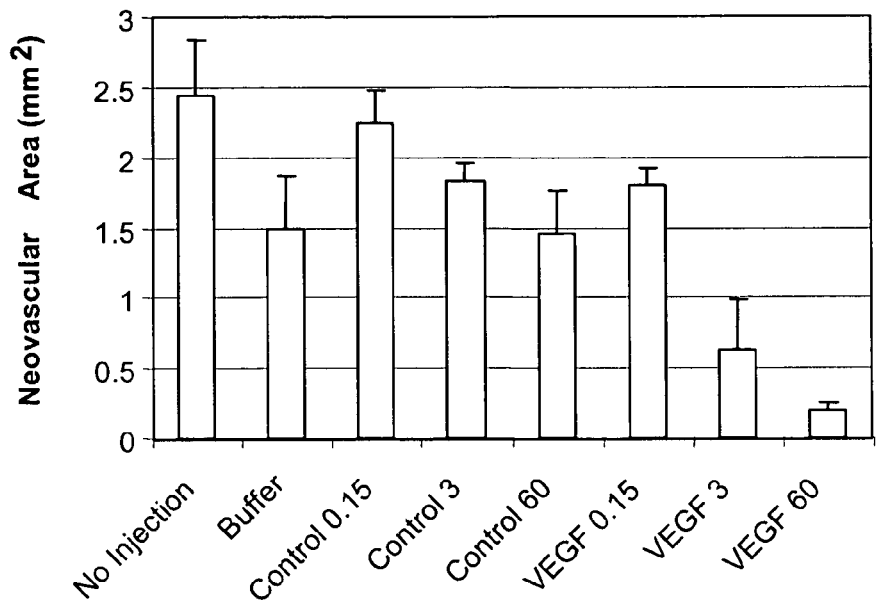
FIG. 56 is a bar graph illustrating the area of pathologic neovascularization in mouse retinas following administration of the indicated agents. "Buffer" is phosphate buffered saline (PBS); "control" is a double-stranded RNA targeting luciferase (AL-DP-3015); "VEGF" is a double-stranded RNA targeting VEGF (AL-DP-4409).

Results. Dose-dependent response of AL-DP-4409 in rat ROP model. Development of neovascularization was pronounced in rats exposed to room air following alternating high oxygen exposure (FIG. 56). Neovascularization was pronounced in rats that were either untreated (n=6; mean=2.442±0.394 $mm^2$) or injected intravitreally with PBS (n=5; mean=1.484±0.386 $mm^2$) at day 14. Rats receiving an intravitreal injection of a control siRNA directed against luciferase (AL-DP-3015) showed no effect of neovascularization as compared to control or buffer-treated mice at any of the siRNA doses tested (60 μg; n=9; mean=1.449±0.320 $mm^2$) (3 ug; n=3; mean=1.827±0.139 $mm^2$) (0.15 μg; n=7; mean=2.249±0.233 $mm^2$) (FIG. 56). In contrast, rats treated with a single intravitreal injection of an siRNA directed against VEGF, identified as AL-DP-4409, showed a dramatic dose-dependent effect on retinal neovascularization (FIG. 56). Administration of 60 μg of AL-DP-4409 VEGF siRNA decreased retinal neovascularization by 85% when compared with rats receiving 60 μg of control luciferase siRNA (n=7; mean=0.200±0.052 $mm^2$; p=0.001). Treatment with 3 μg of AL-DP-4409 VEGF siRNA was also effective, reducing neovascularization by 65% when compared with rats receiving 3 μg of AL-DP-3015 control luciferase siRNA (n=3; mean=0.637±0.344 $mm^2$); p=0.04). Treatment with 0.15 μg of AL-DP-4409 VEGF siRNA had no effect on neovascularization (n=7; mean=1.790±0.127 $mm^2$), thus confirming the dose-responsive effect.

Figure 57:
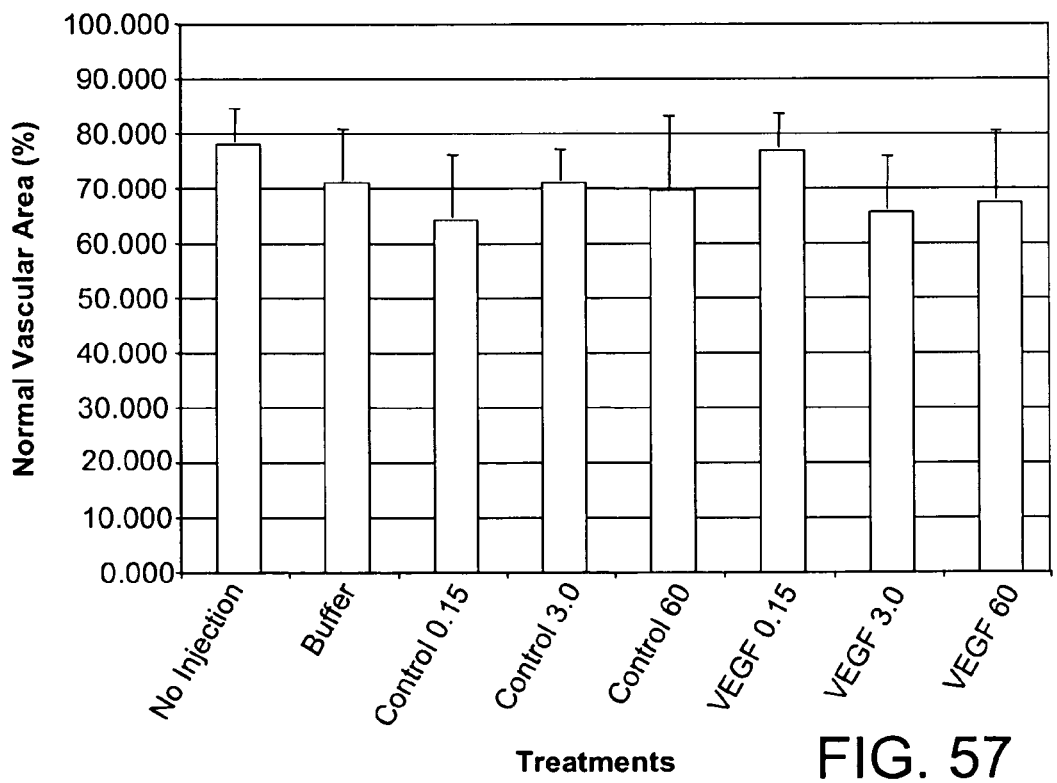
FIG. 57 is a bar graph illustrating the effect of the indicated agents on normal vascularization in mouse retinas. "Buffer" is phosphate buffered saline (PBS); "control" is a double-stranded RNA targeting luciferase (AL-DP-3015); "VEGF" is a double-stranded RNA targeting VEGF (AL-DP-4409).

In contrast to the efficacy seen towards pathologic neovascularization, neither AL-DP-3015 control luciferase siRNA nor AL-DP-4409 VEGF siRNA treatment had any effect on normal vascular development (FIG. 57). Confirmation of the selective and specific effect of AL-DP-4409 VEGF siRNA on pathologic neovascularization and not on normal retinal vasculature was demonstrated in ADP-stained flat mount sections.

Figure 58:
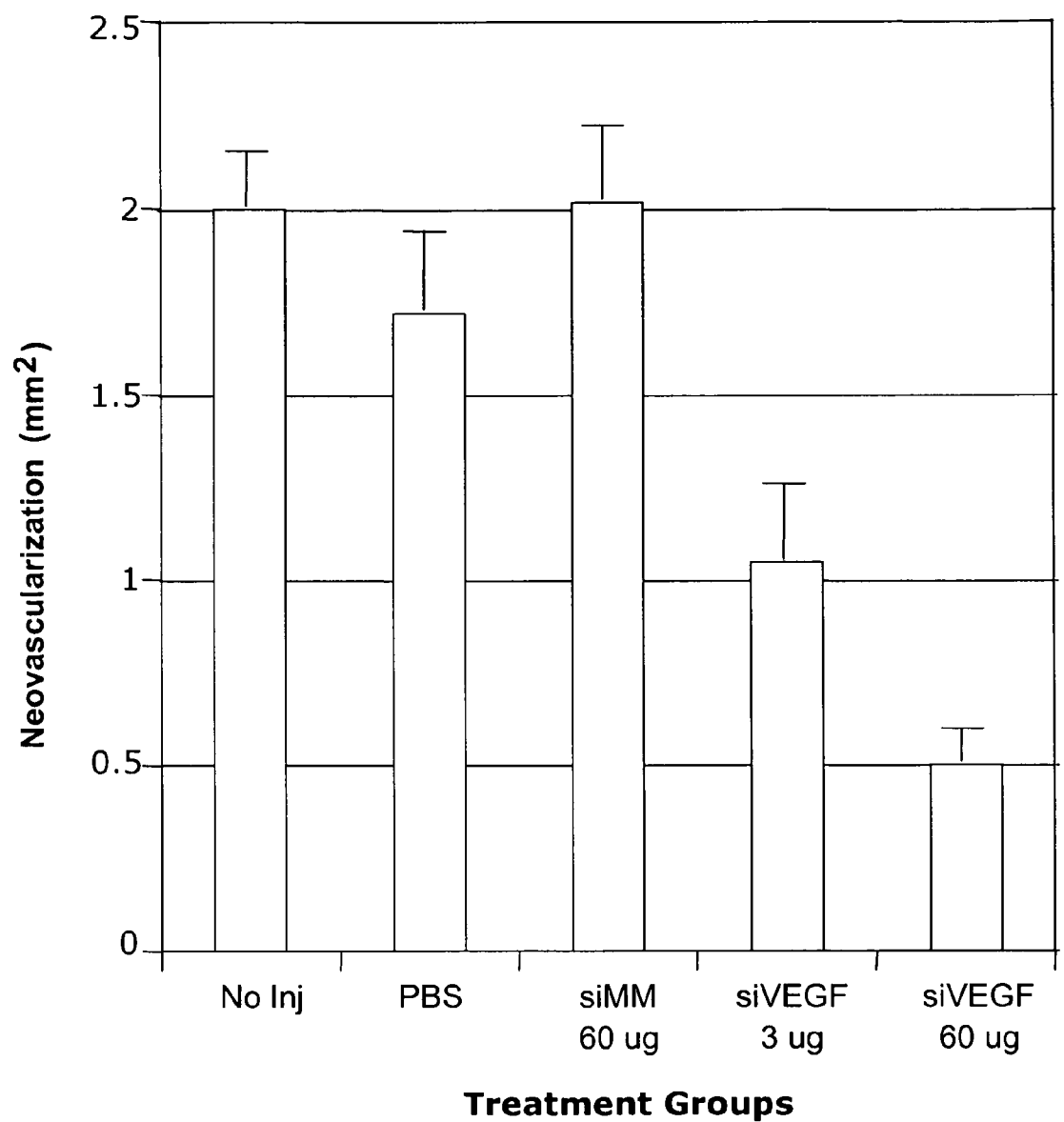
FIG. 58 is a bar graph illustrating the area of pathologic neovascularization in mouse retinas following administration of the indicated agents. "PBS" is phosphate buffered saline; "siMM" is AL-DP-4409 MM, a double-stranded RNA including a mismatch sequence as compared to the double-stranded RNA (siRNA), AL-DP-4409, that targets VEGF; "siVEGF" is AL-DP-4409.
Figure 59:
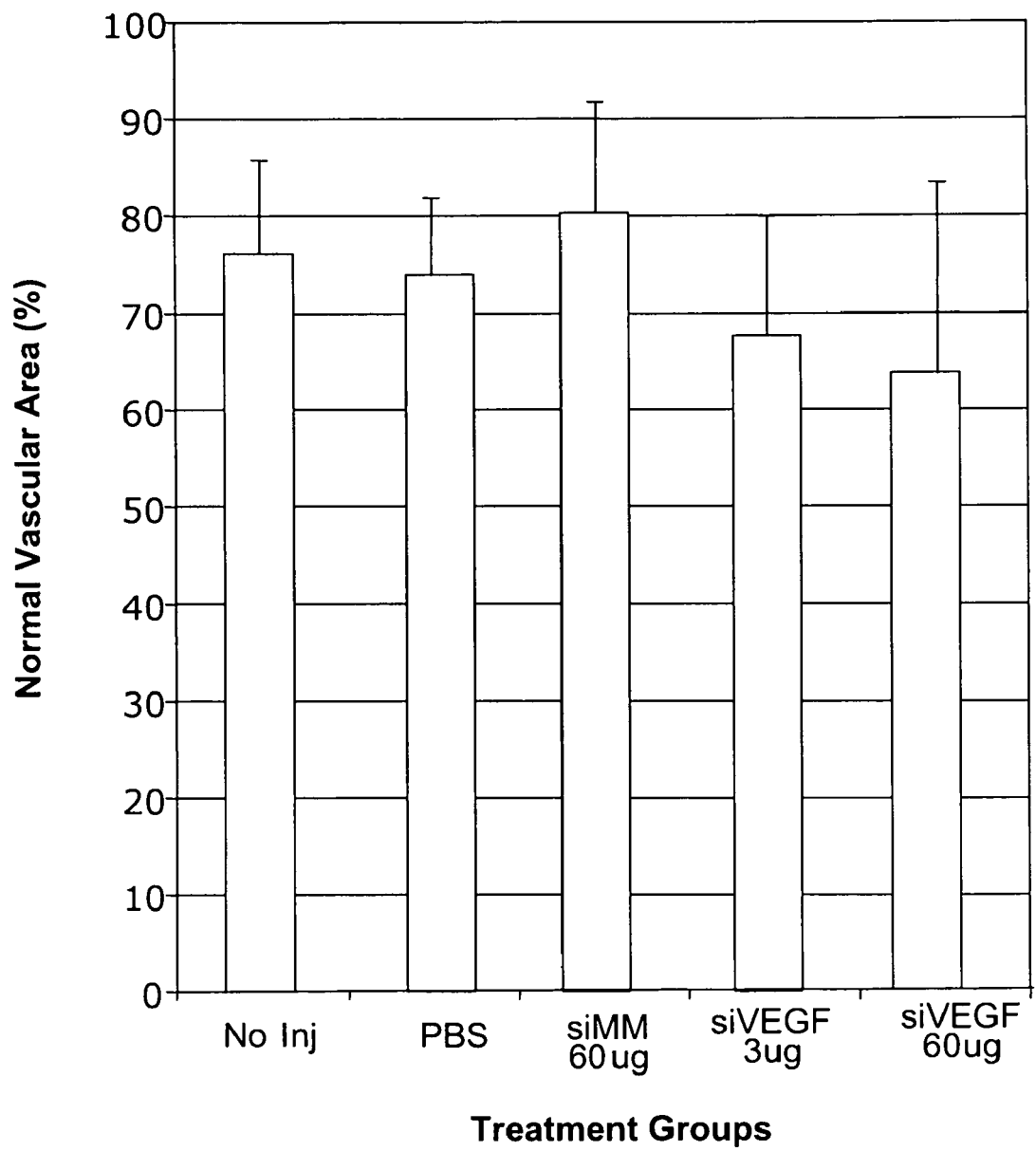
FIG. 59 is a bar graph illustrating the effect of the indicated agents on normal vascularization in mouse retinas. "PBS" is phosphate buffered saline; "siMM" is AL-DP-4409 MM, a double-stranded RNA including a mismatch sequence as compared to the double-stranded RNA (siRNA), AL-DP-4409, that targets VEGF; "siVEGF" is AL-DP-4409.

Specificity of AL-DP-4409 in rat ROP model. To confirm the activity of AL-DP-4409 VEGF siRNA in inhibiting retinal neovascularization, AL-DP-4409 was compared with a specific mismatched siRNA, AL-DP-4409 MM (see above). The mismatch sequence results in loss of in vitro VEGF silencing activity. As demonstrated previously, robust development of retinal neovascularization was seen in animals that received either no intravitreal injection (n=9; mean=1.996±0.151 $mm^2$) or PBS buffer injection (n=7; mean=1.716±0.214 $mm^2$) (FIG. 58). The VEGF mismatch siRNA showed no effect on neovascularization at a 60 μg dose (n=10; mean=2.012±0.200 $mm^2$) (FIG. 58). Confirming previous results, the 60 μg dose of AL-DP-4409 significantly inhibited neovascularization by 75% (n=9; mean=0.503±0.086 $mm^2$; p=0.001 vs MM), while the lower 3 μg dose of AL-Dp-4409 inhibited by 49% (n=9; mean=1.044±0.193 $mm^2$; p=0.18 vs MM). Lastly, none of the siRNA tested had any effect on normal retinal vasculature (FIG. 59).

TABLE 1

Target sequences in VEGF 121

| SEQ ID NO: | ORF | TARGET SEQUENCE IN VEGF121 mRNA 5' to 3' |
|---|---|---|
| 2 | 1 | AUGAACUUUCUGCUGUCUUGGGU |
| 3 | 2 | UGAACUUUCUGCUGUCUUGGGUG |
| 4 | 3 | GAACUUUCUGCUGUCUUGGGUGC |
| 5 | 4 | AACUUUCUGCUGUCUUGGGUGCA |
| 6 | 5 | ACUUUCUGCUGUCUUGGGUGCAU |
| 7 | 6 | CUUUCUGCUGUCUUGGGUGCAUU |
| 8 | 7 | UUUCUGCUGUCUUGGGUGCAUUG |
| 9 | 8 | UUCUGCUGUCUUGGGUGCAUUGG |
| 10 | 9 | UCUGCUGUCUUGGGUGCAUUGGA |
| 11 | 10 | CUGCUGUCUUGGGUGCAUUGGAG |
| 12 | 11 | UGCUGUCUUGGGUGCAUUGGAGC |
| 13 | 12 | GCUGUCUUGGGUGCAUUGGAGCC |

TABLE 1-continued

Target sequences in VEGF 121

| SEQ ID NO: | ORF | TARGET SEQUENCE IN VEGF121 mRNA 5' to 3' |
|---|---|---|
| 14 | 13 | CUGUCUUGGGUGCAUUGGAGCCU |
| 15 | 14 | UGUCUUGGGUGCAUUGGAGCCUU |
| 16 | 15 | GUCUUGGGUGCAUUGGAGCCUUG |
| 17 | 16 | UCUUGGGUGCAUUGGAGCCUUGC |
| 18 | 17 | CUUGGGUGCAUUGGAGCCUUGCC |
| 19 | 18 | UUGGGUGCAUUGGAGCCUUGCCU |
| 20 | 19 | UGGGUGCAUUGGAGCCUUGCCUU |
| 21 | 20 | GGGUGCAUUGGAGCCUUGCCUUG |
| 22 | 21 | GGUGCAUUGGAGCCUUGCCUUGC |
| 23 | 22 | GUGCAUUGGAGCCUUGCCUUGCU |
| 24 | 23 | UGCAUUGGAGCCUUGCCUUGCUG |
| 25 | 24 | GCAUUGGAGCCUUGCCUUGCUGC |
| 26 | 25 | CAUUGGAGCCUUGCCUUGCUGCU |
| 27 | 26 | AUUGGAGCCUUGCCUUGCUGCUC |
| 28 | 27 | UUGGAGCCUUGCCUUGCUGCUCU |
| 29 | 28 | UGGAGCCUUGCCUUGCUGCUCUA |
| 30 | 29 | GGAGCCUUGCCUUGCUGCUCUAC |
| 31 | 30 | AAGCCUUGCCUUGCUGCUCUACC |
| 32 | 31 | GGCCUUGCCUUGCUGCUCUACCU |
| 33 | 32 | CCCUUGCCUUGCUGCUCUACCUC |
| 34 | 33 | CCUUCCCUUGCUGCUCUACCUCC |
| 35 | 34 | CUUGCCUUGCUGCUCUACCUCCA |
| 36 | 35 | UUGCCUUGCUGCUCUACCUCCAC |
| 37 | 36 | UGCCUUGCUGCUCUACCUCCACC |
| 38 | 37 | GCCUUGCUGCUCUACCUCCACCA |
| 39 | 38 | CCUUGCUGCUCUACCUCCACCAU |
| 40 | 39 | CUUGCUGCUCUACCUCCACCAUG |
| 41 | 40 | UUGCUGCUCUACCUCCACCAUGC |
| 42 | 41 | UGCUGCUCUACCUCCACCAUGCC |
| 43 | 42 | GCUGCUCUACCUCCACCAUGCCA |
| 44 | 43 | CUGCUCUACCUCCACCAUGCCAA |
| 45 | 44 | UGCUCUACCUCCACCAUGCCAAG |
| 46 | 45 | GCUCUACCUCCACCAUGCCAAGU |
| 47 | 46 | CUCUACCUCCACCAUGCCAAGUG |
| 48 | 47 | UCUACCUCCACCAUGCCAAGUGG |
| 49 | 48 | CUACCUCCACCAUGCCAAGUGGU |
| 50 | 49 | UACCUCCACCAUGCCAAGUGGUC |
| 51 | 50 | ACCUCCACCAUGCCAAGUGGUCC |
| 52 | 51 | CCUCCACCAUGCCAAGUGGUCCC |
| 53 | 52 | CUCCACCAUGCCAAGUGGUCCCA |
| 54 | 53 | UCCACCAUGCCAAGUGGUCCCAG |
| 55 | 54 | CCACCAUGCCAAGUGGUCCCAGG |
| 56 | 55 | CACCAUGCCAAGUGGUCCCAGGC |
| 57 | 56 | ACCAUGCCAAGUGGUCCCAGGCU |
| 58 | 57 | CCAUGCCAAGUGGUCCCAGGCUG |
| 59 | 58 | CAUGCCAAGUGGUCCCAGGCUGC |
| 60 | 59 | AUGCCAAGUGGUCCCAGGCUGCA |
| 61 | 60 | UGCCAAGUGGUCCCAGGCUGCAC |
| 62 | 61 | GCCAAGUGGUCCCAGGCUGCACC |
| 63 | 62 | CCAAGUGGUCCCAGGCUGCACCC |
| 64 | 63 | CAAGUGGUCCCAGGCUGCACCCA |
| 65 | 64 | AAGUGGUCCCAGGCUGCACCCAU |
| 66 | 65 | AGUGGUCCCAGGCUGCACCCAUG |
| 67 | 66 | GUGGUCCCAGGCUGCACCCAUGG |
| 68 | 67 | UGGUCCCAGGCUGCACCCAUGGC |
| 69 | 68 | GGUCCCAGGCUGCACCCAUGGCA |
| 70 | 69 | GUCCCAGGCUGCACCCAUGGCAG |
| 71 | 70 | UCCCAGGCUGCACCCAUGGCAGA |
| 72 | 71 | CCCAGGCUGCACCCAUGGCAGAA |
| 73 | 72 | CCAGGCUGCACCCAUGGCAGAAG |
| 74 | 73 | CAGGCUGCACCCAUGGCAGAAGG |
| 75 | 74 | AGGCUGCACCCAUGGCAGAAGGA |
| 76 | 75 | GGCUGCACCCAUGGCAGAAGGAG |
| 77 | 76 | GCUGCACCCAUGGCAGAAGGAGG |
| 78 | 77 | CUGCACCCAUGGCAGAAGGAGGA |
| 79 | 78 | UGCACCCAUGGCAGAAGGAGGAG |
| 80 | 79 | GCACCCAUGGCAGAAGGAGGAGG |
| 81 | 80 | CACCCAUGGCAGAAGGAGGAGGG |
| 82 | 81 | ACCCAUGGCAGAAGGAGGAGGGC |
| 83 | 82 | CCCAUGGCAGAAGGAGGAGGGCA |
| 84 | 83 | CCAUGGCAGAAGGAGGAGGGCAG |
| 85 | 84 | CAUGGCAGAAGGAGGAGGGCAGA |
| 86 | 85 | AUGGCAGAAGGAGGAGGGCAGAA |
| 87 | 86 | UGGCAGAAGGAGGAGGGCAGAAU |
| 88 | 87 | GGCAGAAGGAGGAGGGCAGAAUC |

TABLE 1-continued

Target sequences in VEGF 121

| SEQ ID NO: | ORF | TARGET SEQUENCE IN VEGF121 mRNA 5' to 3' |
|---|---|---|
| 89 | 88 | GCAGAAGGAGGAGGGCAGAAUCA |
| 90 | 89 | CAGAAGGAGGAGGGCAGAAUCAU |
| 91 | 90 | AGAAGGAGGAGGGCAGAAUCAUC |
| 92 | 91 | GAAGGAGGAGGGCAGAAUCAUCA |
| 93 | 92 | AAGGAGGAGGGCAGAAUCAUCAC |
| 94 | 93 | AGGAGGAGGGCAGAAUCAUCACG |
| 95 | 94 | GGAGGAGGGCAGAAUCAUCACGA |
| 96 | 95 | GAGGAGGGCAGAAUCAUCACGAA |
| 97 | 96 | AGGAGGGCAGAAUCAUCACGAAG |
| 98 | 97 | GGAGGGCAGAAUCAUCACGAAGU |
| 99 | 98 | GAGGGCAGAAUCAUCACGAAGUG |
| 100 | 99 | AGGGCAGAAUCAUCACGAAGUGG |
| 101 | 100 | GGGCAGAAUCAUCACGAAGUGGU |
| 102 | 101 | GGCAGAAUCAUCACGAAGUGGUG |
| 103 | 102 | GCAGAAUCAUCACGAAGUGGUGA |
| 104 | 103 | CAGAAUCAUCACGAAGUGGUGAA |
| 105 | 104 | AGAAUCAUCACGAAGUGGUGAAG |
| 106 | 105 | GAAUCAUCACGAAGUGGUGAAGU |
| 107 | 106 | AAUCAUCACGAAGUGGUGAAGUU |
| 108 | 107 | AUCAUCACGAAGUGGUGAAGUUC |
| 109 | 108 | UCAUCACGAAGUGGUGAAGUUCA |
| 110 | 109 | CAUCACGAAGUGGUGAAGUUCAU |
| 111 | 110 | AUCACGAAGUGGUGAAGUUCAUG |
| 112 | 111 | UCACGAAGUGGUGAAGUUCAUGG |
| 113 | 112 | CACGAAGUGGUGAAGUUCAUGGA |
| 114 | 113 | ACGAAGUGGUGAAGUUCAUGGAU |
| 115 | 114 | CGAAGUGGUGAAGUUCAUGGAUG |
| 116 | 115 | GAAGUGGUGAAGUUCAUGGAUGU |
| 117 | 116 | AAGUGGUGAAGUUCAUGGAUGUC |
| 118 | 117 | AGUGGUGAAGUUCAUGGAUGUCU |
| 119 | 118 | GUGGUGAAGUUCAUGGAUGUCUA |
| 120 | 119 | UGGUGAAGUUCAUGGAUGUCUAU |
| 121 | 120 | GGUGAAGUUCAUGGAUGUCUAUC |
| 122 | 121 | GUGAAGUUCAUGGAUGUCUAUCA |
| 123 | 122 | UGAAGUUCAUGGAUGUCUAUCAG |
| 124 | 123 | GAAGUUCAUGGAUGUCUAUCAGC |
| 125 | 124 | AAGUUCAUGGAUGUCUAUCAGCC |
| 126 | 125 | AGUUCAUGGAUGUCUAUCAGCGC |
| 127 | 126 | GUUCAUGGAUGUCUAUCAGCGCA |
| 128 | 127 | UUCAUGGAUGUCUAUCAGCGCAG |
| 129 | 128 | UCAUGGAUGUCUAUCAGCGCAGC |
| 130 | 129 | CAUGGAUGUCUAUCAGCGCAGCU |
| 131 | 130 | AUGGAUGUCUAUCAGCGCAGCUA |
| 132 | 131 | UGGAUGUCUAUCAGCGCAGCUAC |
| 133 | 132 | GGAUGUCUAUCAGCGCAGCUACU |
| 134 | 133 | GAUGUCUAUCAGCGCAGCUACUG |
| 135 | 134 | AUGUCUAUCAGCGCAGCUACUGC |
| 136 | 135 | UGUCUAUCAGCGCAGCUACUGCC |
| 137 | 136 | GUCUAUCAGCGCAGCUACUGCCA |
| 138 | 137 | UCUAUCAGCGCAGCUACUGCCAU |
| 139 | 138 | CUAUCAGCGCAGCUACUGCCAUC |
| 140 | 139 | UAUCAGCGCAGCUACUGCCAUCC |
| 141 | 140 | AUCAGCGCAGCUACUGCCAUCCA |
| 142 | 141 | UCAGCGCAGCUACUGCCAUCCAA |
| 143 | 142 | CAGCGCAGCUACUGCCAUCCAAU |
| 144 | 143 | AGCGCAGCUACUGCCAUCCAAUC |
| 145 | 144 | GCGCAGCUACUGCCAUCCAAUCG |
| 146 | 145 | CGCAGCUACUGCCAUCCAAUCGA |
| 147 | 146 | GCAGCUACUGCCAUCCAAUCGAG |
| 148 | 147 | CAGCUACUGCCAUCCAAUCGAGA |
| 149 | 148 | AGCUACUGCCAUCCAAUCGAGAC |
| 150 | 149 | GCUACUGCCAUCCAAUCGAGACC |
| 151 | 150 | CUACUGCCAUCCAAUCGAGACCC |
| 152 | 151 | UACUGCCAUCCAAUCGAGACCCU |
| 153 | 152 | ACUGCCAUCCAAUCGAGACCCUG |
| 154 | 153 | CUGCCAUCCAAUCGAGACCCUGG |
| 155 | 154 | UGCCAUCCAAUCGAGACCCUGGU |
| 156 | 155 | GCCAUCCAAUCGAGACCCUGGUG |
| 157 | 156 | CCAUCCAAUCGAGACCCUGGUGG |
| 158 | 157 | CAUCCAAUCGAGACCCUGGUGGA |
| 159 | 158 | AUCCAAUCGAGACCCUGGUGGAC |
| 160 | 159 | UCCAAUCGAGACCCUGGUGGACA |
| 161 | 160 | CCAAUCGAGACCCUGCUGGACAU |
| 162 | 161 | CAAUCGAGACCCUGGUGGACAUC |
| 163 | 162 | AAUCGAGACCCUGGUGGACAUCU |

TABLE 1-continued

Target sequences in VEGF 121

| SEQ ID NO: | ORF | TARGET SEQUENCE IN VEGF121 mRNA 5' to 3' |
|---|---|---|
| 164 | 163 | AUCGAGACCCUGGUGGACAUCUU |
| 165 | 164 | UCGAGACCCUGGUGGACAUCUUC |
| 166 | 165 | CGAGACCCUGGUGGACAUCUUCC |
| 167 | 166 | GAGACCCUGGUGGACAUCUUCCA |
| 168 | 167 | AGACCCUGGUGGACAUCUUCCAG |
| 169 | 168 | GACCCUGGUGGACAUCUUCCAGG |
| 170 | 169 | ACCCUGGUGGACAUCUUCCAGGA |
| 171 | 170 | CCCUGGUGGACAUCUUCCAGGAG |
| 172 | 171 | CCUGGUGGACAUCUUCCAGGAGU |
| 173 | 172 | CUGGUCGACAUCUUCCAGGAGUA |
| 174 | 173 | UGGUGGACAUCUUCCAGGAGUAC |
| 175 | 174 | GGUGGACAUCUUCCAGGAGUACC |
| 176 | 175 | GUCGACAUCUUCCAGGAGUACCC |
| 177 | 176 | UGGACAUCUUCCAGGAGUACCCU |
| 178 | 177 | GGACAUCUUCCAGGAGUACCCUG |
| 179 | 178 | GACAUCUUCCAGGAGUACCCUGA |
| 180 | 179 | ACAUCUUCCAGGAGUACCCUGAU |
| 181 | 180 | CAUCUUCCAGGAGUACCCUGAUG |
| 182 | 181 | AUCUUCCAGGAGUACCCUGAUGA |
| 183 | 182 | UCUUCCAGGAGUACCCUGAUGAG |
| 184 | 183 | CUUCCAGGAGUACCCUGAUGAGA |
| 185 | 184 | UUCCAGGAGUACCCUGAUGAGAU |
| 186 | 185 | UCCAGGAGUACCCUGAUGAGAUC |
| 187 | 186 | CCAGGAGUACCCUGAUGAGAUCG |
| 188 | 187 | CAGGAGUACCCUGAUGAGAUCGA |
| 189 | 188 | AGGAGUACCCUGAUGAGAUCGAG |
| 190 | 189 | GGAGUACCCUGAUGAGAUCGAGU |
| 191 | 190 | GAGUACCCUGAUGAGAUCGAGUA |
| 192 | 191 | AGUACCCUGAUGAGAUCGAGUAC |
| 193 | 192 | GUACCCUGAUGAGAUCGAGUACA |
| 194 | 193 | UACCCUGAUGAGAUCGAGUACAU |
| 195 | 194 | ACCCUGAUGAGAUCGAGUACAUC |
| 196 | 195 | CCCUGAUGAGAUCGAGUACAUCU |
| 197 | 196 | CCUGAUGAGAUCGAGUACAUCUU |
| 198 | 197 | CUGAUGAGAUCGAGUACAUCUUC |
| 199 | 198 | UGAUGAGAUCGAGUACAUCUUCA |
| 200 | 199 | GAUGAGAUCGAGUACAUCUUCAA |
| 201 | 200 | AUGAGAUCGAGUACAUCUUCAAG |
| 202 | 201 | UGAGAUCGAGUACAUCUUCAAGC |
| 203 | 202 | GAGAUCGAGUACAUCUUCAAGCC |
| 204 | 203 | AGAUCGAGUACAUCUUCAAGCCA |
| 205 | 204 | GAUCGAGUACAUCUUCAAGCCAU |
| 206 | 205 | AUCGAGUACAUCUUCAAGCCAUC |
| 207 | 206 | UCGAGUACAUCUUCAAGCCAUCC |
| 208 | 207 | CGAGUACAUCUUCAAGCCAUCCU |
| 209 | 208 | GAGUACAUCUUCAAGCCAUCCUG |
| 210 | 209 | AGUACAUCUUCAAGCCAUCCUGU |
| 211 | 210 | GUACAUCUUCAAGCCAUCCUGUG |
| 212 | 211 | UACAUCUUCAAGCCAUCCUGUGU |
| 213 | 212 | ACAUCUUCAAGCCAUCCUGUGUG |
| 214 | 213 | CAUCUUCAAGCCAUCCUGUGUGC |
| 215 | 214 | AUCUUCAAGCCAUCCUGUGUGCC |
| 216 | 215 | UCUUCAAGCCAUCCUGUGUGCCC |
| 217 | 216 | CUUCAAGCCAUCCUGUGUGCCCC |
| 218 | 217 | UUCAAGCCAUCCUGGUGCCCCU |
| 219 | 218 | UCAAGCCAUCCUGUGUGCCCCUG |
| 220 | 219 | CAAGCCAUCCUGUGUGCCCCUGA |
| 221 | 220 | AAGCCAUCCUGUGUGCCCCUGAU |
| 222 | 221 | AGCCAUCCUGUGUGCCCCUGAUG |
| 223 | 222 | GCCAUCCUGUGUGCCCCUGAUGC |
| 224 | 223 | CCAUCCUGUGUGCCCCUGAUGCG |
| 225 | 224 | CAUCCUGUGUGCCCCUGAUGCGA |
| 226 | 225 | AUCCUGUGUGCCCCUGAUGCGAU |
| 227 | 226 | UCCUGUGUGCCCCUGAUGCGAUG |
| 228 | 227 | CCUGUGUGCCCCUGAUGCGAUGC |
| 229 | 228 | CUGUGUGCCCCUGAUGCGAUGCG |
| 230 | 229 | UGUGUGCCCCUGAUGCGAUGCGG |
| 231 | 230 | GUGUGCCCCUGAUGCGAUGCGGG |
| 232 | 231 | UGUGCCCCUGAUGCGAUGCGGGG |
| 233 | 232 | GUGCCCCUGAUGCGAUGCGGGGG |
| 234 | 233 | UGCCCCUGAUGCGAUGCGGGGGC |
| 235 | 234 | GCCCCUGAUGCGAUGCGGGGGCU |
| 236 | 235 | CCCCUGAUGCGAUGCGGGGGCUG |
| 237 | 236 | CCCUGAUGCGAUGCGGGGGCUGC |
| 238 | 237 | CCUGAUGCGAUGCGGGGGCUGCU |

TABLE 1-continued

Target sequences in VEGF 121

| SEQ ID NO: | ORF | TARGET SEQUENCE IN VEGF121 mRNA 5' to 3' |
|---|---|---|
| 239 | 238 | CUGAUGCGAUGCGGGGCUGCUG |
| 240 | 239 | UGAUGCGAUGCGGGGCUGCUGC |
| 241 | 240 | GAUGCGAUGCGGGGCUGCUGCA |
| 242 | 241 | AUGCGAUGCGGGGCUGCUGCAA |
| 243 | 242 | UGCGAUGCGGGGCUGCUGCAAU |
| 244 | 243 | GCGAUGCGGGGCUGCUGCAAUG |
| 245 | 244 | CGAUGCGGGGCUGCUGCAAUGA |
| 246 | 245 | GAUGCGGGGCUGCUGCAAUGAC |
| 247 | 246 | AUGCGGGGCUGCUGCAAUGACG |
| 248 | 247 | UGCGGGGCUGCUGCAAUGACGA |
| 249 | 248 | GCGGGGCUGCUGCAAUGACGAG |
| 250 | 249 | CGGGGGCUGCUGCAAUGACGAGG |
| 251 | 250 | GGGGGCUGCUGCAAUGACGAGGG |
| 252 | 251 | GGGGCUGCUGCAAUGACGAGGGC |
| 253 | 252 | GGGCUGCUGCAAUGACGAGGGCC |
| 254 | 253 | GGCUGCUGCAAUGACGAGGGCCU |
| 255 | 254 | GCUGCUGCAAUGACGAGGGCCUG |
| 256 | 255 | CUGCUGCAAUGACGAGGGCCUGG |
| 257 | 256 | UGCUGCAAUGACGAGGGCCUGGA |
| 258 | 257 | GCUGCAAUGACGAGGGCCUGGAG |
| 259 | 258 | CUGCAAUGACGAGGGCCUGGAGU |
| 260 | 259 | UGCAAUGACGAGGGCCUGGAGUG |
| 261 | 260 | GCAAUGACGAGGGCCUGCAGUGU |
| 262 | 261 | CAAUGACGAGGGCCUGGAGUGUG |
| 263 | 262 | AAUGACGAGGGCCUGGAGUGUGU |
| 264 | 263 | AUGACGAGGGCCUGGAGUGUGUC |
| 265 | 264 | UGACGAGGGCCUGGAGUGUGUGC |
| 266 | 265 | GACGAGGGCCUGGAGUGUGUGCC |
| 267 | 266 | ACGAGGGCCUGGAGUGUGUGCCC |
| 268 | 267 | CGAGGGCCUGGAGUGUGUGCCCA |
| 269 | 268 | GAGGGCCUGGAGUGUGUGCCCAC |
| 270 | 269 | AGGGCCUGGAGUGUGUGCCCACU |
| 271 | 270 | GGGCCUGGAGUGUGUGCCCACUG |
| 272 | 271 | GGCCUGGAGUGUGUGCCCACUGA |
| 273 | 272 | GCCUGGAGUGUGUGCCCACUGAG |
| 274 | 273 | CCUGGAGUGUGUGCCCACUGAGG |
| 275 | 274 | CUGGAGUGUGUGCCCACUGAGGA |
| 276 | 275 | UGCAGUGUGUGCCCACUGAGGAG |
| 277 | 276 | GGAGUGUGUGCCCACUGAGGAGU |
| 278 | 277 | GAGUGUGUGCCCACUGAGGAGUC |
| 279 | 278 | AGUGUGUGCCCACUGAGGAGUCC |
| 280 | 279 | GUGUGUGCCCACUGAGGAGUCCA |
| 281 | 280 | UGUGUGCCCACUGAGGAGUCCAA |
| 282 | 281 | GUGUGCCCACUGAGGAGUCCAAC |
| 283 | 282 | UGUGCCCACUGAGGAGUCCAACA |
| 284 | 283 | GUGCCCACUGAGGAGUCCAACAU |
| 285 | 284 | UGCCCACUGAGGAGUCCAACAUC |
| 286 | 285 | GCCCACUGAGGAGUCCAACAUCA |
| 287 | 286 | CCCACUGAGGAGUCCAACAUCAC |
| 288 | 287 | CCACUGAGGAGUCCAACAUCACC |
| 289 | 288 | CACUGAGGAGUCCAACAUCACCA |
| 290 | 289 | ACUGAGGAGUCCAACAUCACCAU |
| 291 | 290 | CUGAGGAGUCCAACAUCACCAUG |
| 292 | 291 | UGAGGAGUCCAACAUCACCAUGC |
| 293 | 292 | GAGGAGUCCAACAUCACCAUGCA |
| 294 | 293 | AGGAGUCCAACAUCACCAUGCAG |
| 295 | 294 | GGAGUCCAACAUCACCAUGCAGA |
| 296 | 295 | GAGUCCAACAUCACCAUGCAGAU |
| 297 | 296 | AGUCCAACAUCACCAUGCAGAUU |
| 298 | 297 | GUCCAACAUCACCAUGCAGAUUA |
| 299 | 298 | UCCAACAUCACCAUGCAGAUUAU |
| 300 | 299 | CCAACAUCACCAUGCAGAUUAUG |
| 301 | 300 | CAACAUCACCAUGCAGAUUAUGC |
| 302 | 301 | AACAUCACCAUGCAGAUUAUGCG |
| 303 | 302 | CCAUCACCAUGCAGAUUAUGCGG |
| 304 | 303 | CAUCACCAUGCAGAUUAUGCGGA |
| 305 | 304 | AUCACCAUGCAGAUUAUGCGGAU |
| 306 | 305 | UCACCAUGCAGAUUAUGCGGAUC |
| 307 | 306 | CACCAUGCAGAUUAUGCGGAUCA |
| 308 | 307 | ACCAUGCAGAUUAUGCGGAUCAA |
| 309 | 308 | CCAUGCAGAUUAUGCGGAUCAAA |
| 310 | 309 | CAUGCAGAUUAUGCGGAUCAAAC |
| 311 | 310 | AUGCAGAUUAUGCGGAUCAAACC |
| 312 | 311 | UGCAGAUUAUGCGGAUCAAACCU |
| 313 | 312 | GCAGAUUAUGCGGAUCAAACCUC |

TABLE 1-continued

Target sequences in VEGF 121

| SEQ ID NO: | ORF | TARGET SEQUENCE IN VEGF121 mRNA 5' to 3' |
|---|---|---|
| 314 | 313 | CAGAUUAUGCGGAUCAAACCUCA |
| 315 | 314 | AGAUUAUGCGGAUCAAACCUCAC |
| 316 | 315 | GAUUAUGCGGAUCAAACCUCACC |
| 317 | 316 | AUUAUGCGGAUCAAACCUCACCA |
| 318 | 317 | UUAUGCGGAUCAAACCUCACCAA |
| 319 | 318 | UAUGCGGAUCAAACCUCACCAAG |
| 320 | 319 | AUGCGGAUCAAACCUCACCAAGG |
| 321 | 320 | UGCGGAUCAAACCUCACCAAGGC |
| 322 | 321 | GCGGAUCAAACCUCACCAAGGCC |
| 323 | 322 | CGGAUCAAACCUCACCAAGGCCA |
| 324 | 323 | GGAUCAAACCUCACCAAGGCCAG |
| 325 | 324 | GAUCAAACCUCACCAAGGCCAGC |
| 326 | 325 | AUCAAACCUCACCAAGGCCAGCA |
| 327 | 326 | UCAAACCUCACCAAGGCCAGCAC |
| 328 | 327 | CAAACCUCACCAAGGCCAGCACA |
| 329 | 328 | AAACCUCACCAAGGCCAGCACAU |
| 330 | 329 | AACCUCACCAAGGCCAGCACAUA |
| 331 | 330 | ACCUCACCAAGGCCAGCACAUAG |
| 332 | 331 | CCUCACCAAGGCCAGCACAUAGG |
| 333 | 332 | CUCACCAAGGCCAGCACAUAGGA |
| 334 | 333 | UCACCAAGGCCAGCACAUAGGAG |
| 335 | 334 | CACCAAGGCCAGCACAUAGGAGA |
| 336 | 335 | ACCAAGGCCAGCACAUAGGAGAG |
| 337 | 336 | CCAAGGCCAGCACAUAGGAGAGA |
| 338 | 337 | CAAGGCCAGCACAUAGGAGAGAU |
| 339 | 338 | AAGGCCAGCACAUAGGAGAGAUG |
| 340 | 339 | AGGCCAGCACAUAGGAGAGAUGA |
| 341 | 340 | GGCCAGCACAUAGGAGAGAUGAG |
| 342 | 341 | GCCAGCACAUAGGAGAGAUGAGC |
| 343 | 342 | CCAGCACAUAGGAGAGAUGAGCU |
| 344 | 343 | CAGCACAUAGGAGAGAUGAGCUU |
| 345 | 344 | AGCACAUAGGAGAGAUGAGCUUC |
| 346 | 345 | GCACAUAGGAGAGAUGAGCUUCC |
| 347 | 346 | CACAUAGGAGAGAUGAGCUUCCU |
| 348 | 347 | ACAUAGGAGAGAUGAGCUUCCUA |
| 349 | 348 | CAUAGGAGAGAUGAGCUUCCUAC |
| 350 | 349 | AUAGGAGAGAUGAGCUUCCUACA |
| 351 | 350 | UAGGAGAGAUGAGCUUCCUACAG |
| 352 | 351 | AGGAGAGAUGAGCUUCCUACAGC |
| 353 | 352 | GGAGAGAUGAGCUUCCUACAGCA |
| 354 | 353 | GAGAGAUGAGCUUCCUACAGCAC |
| 355 | 354 | AGAGAUGAGCUUCCUACAGCACA |
| 356 | 355 | GAGAUGAGCUUCCUACAGCACAA |
| 357 | 356 | AGAUGAGCUUCCUACAGCACAAC |
| 358 | 357 | GAUGAGCUUCCUACAGCACAACA |
| 359 | 358 | AUGAGCUUCCUACAGCACAACAA |
| 360 | 359 | UGAGCUUCCUACAGCACAACAAA |
| 361 | 360 | GAGCUUCCUACAGCACAACAAAU |
| 362 | 361 | AGCUUCCUACAGCACAACAAAUG |
| 363 | 362 | GCUUCCUACAGCACAACAAAUGU |
| 364 | 363 | CUUCCUACAGCACAACAAAUGUG |
| 365 | 364 | UUCCUACAGCACAACAAAUGUGA |
| 366 | 365 | UCCUACAGCACAACAAAUGUGAA |
| 367 | 366 | CCUACAGCACAACAAAUGUGAAU |
| 368 | 367 | CUACAGCACAACAAAUGUGAAUG |
| 369 | 368 | UACAGCACAACAAAUGUGAAUGC |
| 370 | 369 | ACAGCACAACAAAUGUGAAUGCA |
| 372 | 370 | CAGCACAACAAAUGUGAAUGCAG |
| 372 | 371 | AGCACAACAAAUGUGAAUGCAGA |
| 373 | 372 | GCACAACAAAUGUGAAUGCAGAC |
| 374 | 373 | CACAACAAAUGUGAAUGCAGACC |
| 375 | 374 | ACAACAAAUGUGAAUGCAGACCA |
| 376 | 375 | CAACAAAUGUGAAUGCAGACCAA |
| 377 | 376 | AACAAAUGUGAAUGCAGACCAAA |
| 378 | 377 | ACAAAUGUGAAUGCAGACCAAAG |
| 379 | 378 | CAAAUGUGAAUGCAGACCAAAGA |
| 380 | 379 | AAAUGUGAAUGCAGACCAAAGAA |
| 381 | 380 | AAUGUGAAUGCAGACCAAAGAAA |
| 382 | 381 | AUGUGAAUGCAGACCAAAGAAAG |
| 383 | 382 | UGUGAAUGCAGACCAAAGAAAGA |
| 384 | 383 | GUGAAUGCAGACCAAAGAAAGAU |
| 385 | 384 | UCAAUGCAGACCAAAGAAAGAUA |
| 386 | 385 | GAAUGCAGACCAAAGAAAGAUAG |
| 387 | 386 | AAUGCAGACCAAAGAAAGAUAGA |
| 388 | 387 | AUGCAGACCAAAGAAAGAUAGAG |

TABLE 1-continued

Target sequences in VEGF 121

| SEQ ID NO: | ORF | TARGET SEQUENCE IN VEGF121 mRNA 5' to 3' |
|---|---|---|
| 389 | 388 | UGCAGACCAAAGAAAGAUAGAGC |
| 390 | 389 | GCAGACCAAAGAAAGAUAGAGCA |
| 391 | 390 | CAGACCAAAGAAAGAUAGAGCAA |
| 392 | 391 | AGACCAAAGAAAGAUAGAGCAAG |
| 393 | 392 | GACCAAAGAAAGAUAGAGCAAGA |
| 394 | 393 | ACCAAAGAAAGAUAGAGCAAGAC |
| 395 | 394 | CCAAAGAAAGAUAGAGCAAGACA |
| 396 | 395 | CAAAGAAAGAUAGAGCAAGACAA |
| 397 | 396 | AAAGAAAGAUAGAGCAAGACAAG |
| 398 | 397 | AAGAAAGAUAGAGCAAGACAAGA |
| 399 | 398 | AGAAAGAUAGAGCAAGACAAGAA |
| 400 | 399 | GAAAGAUAGAGCAAGACAAGAAA |
| 401 | 400 | AAAGAUAGAGCAAGACAAGAAAA |

TABLE 2

| Position in ORF | SEQ ID NO: | Target sequence (5'-3') | Alnylam DUP ID | Strand | SEQ ID NO: | Sequences | Efficacy HeLa | Efficacy hRPE |
|---|---|---|---|---|---|---|---|---|
| 1 | 2 | AUGAACUUUCUGCUGUCUUGGGU | AL-DP-4043 | S | 402 | 5 GAACUUUCUGCUGUCUUGGGU 3 | +++ | NA |
| | | | | AS | 403 | 3 UACUUGAAAGACGACAGAACCCA 5 | | |
| 22 | 23 | GUGCAUUGGAGCCUUGCCUUGCU | AL-DP-4077 | S | 404 | 5 GCAUUGGAGCCUUGCCUUGCU 3 | +++ | NA |
| | | | | AS | 405 | 3 CACGUAACCUCGGAACGGAACGA 5 | | |
| 47 | 48 | UCUACCUCCACCAUGCCAAGUGG | AL-DP-4021 | S | 406 | 5 UACCUCCACCAUGCCAAGUTT 3 | + | NA |
| | | | | AS | 407 | 3 TTAUGGAGGUGGUACGGUUCA 5 | | |
| 48 | 49 | CUACCUCCACCAUGCCAAGUGGU | AL-DP-4109 | S | 408 | 5 ACCUCCACCAUGCCAAGUGTT 3 | + | NA |
| | | | | AS | 409 | 3 TTUGGAGGUGGUACGGUUCAC 5 | | |
| 50 | 51 | ACCUCCACCAUGCCAAGUGGUCC | AL-DP-4006 | S | 410 | 5 CUCCACCAUGCCAAGUGGUCC 3 | +++ | + |
| | | | | AS | 411 | 3 UGGAGGUGGUACGGUUCACCAGG 5 | | |
| | | | AL-DP-4083 | S | 412 | 5 CUCCACCAUGCCAAGUGGUTT 3 | ++ | ++ |
| | | | | AS | 413 | 3 TTGAGGUGGUACGGUUCACCA 5 | | |
| 51 | 52 | CCUCCACCAUGCCAAGUGGUCCC | AL-DP-4047 | S | 414 | 5 UCCACCAUGCCAAGUGGUCCC 3 | + | NA |
| | | | | AS | 415 | 3 GGAGGUGGUACGGUUCACCAGGG 5 | | |
| | | | AL-DP-4017 | A | 416 | 5 UCCACCAUGCCAAGUGGUCTT 3 | + | NA |
| | | | | AS | 417 | 3 TTAGGUGGUACGGUUCACCAG 5 | | |
| 52 | 53 | CUCCACCAUGCCAAGUGGUCCCA | AL-DP-4048 | S | 418 | 5 CCACCAUGCCAAGUGGUCCCA 3 | ++ | ++ |
| | | | | AS | 419 | 3 GAGGUGGUACGGUUCACCAGGGU 5 | | |
| | | | AL-DP-4103 | S | 420 | 5 CCACCAUGCCAAGUGGUCCTT 3 | ++/+ | ++ |
| | | | | AS | 421 | 3 TTGGUGGUACGGUUCACCAGG 5 | | |
| 53 | 54 | UCCACCAUGCCAAGUGGUCCCAG | AL-DP-4035 | S | 422 | 5 CACCAUGCCAAGUGGUCCCAG 3 | ++ | + |
| | | | | AS | 423 | 3 AGGUGGUACGGUUCACCAGGGUC 5 | | |
| | | | AL-DP-4018 | S | 424 | 5 CACCAUGCCAAGUGGUCCCTT 3 | ++/++ | + |
| | | | | AS | 425 | 3 TTGUGGUACGGUUCACCAGGG 5 | | |
| 54 | 55 | CCACCAUGCCAAGUGGUCCCAGG | AL-DP-4036 | S | 426 | 5 ACCAUGCCAAGUGGUCCCAGG 3 | +++ | ++ |
| | | | | AS | 427 | 3 GGUGGUACGGUUCACCAGGGUCC 5 | | |
| | | | AL-DP-4084 | S | 428 | 5 ACCAUGCCAAGUGGUCCCATT 3 | ++ | + |
| | | | | AS | 429 | 3 TTGGUACGGUUCACCAGGGU 5 | | |
| 55 | 56 | CACCAUGCCAAGUGGUCCCAGGC | AL-DP-4093 | S | 430 | 5 CCAUGCCAAGUGGUCCCAGGC 3 | ++ | + |
| | | | | AS | 431 | 3 GUGGUACGGUUCACCAGGGUCCG 5 | | |
| | | | AL-DP-4085 | S | 432 | 5 CCAUGCCAAGUGGUCCCAGTT 3 | + | + |
| | | | | AS | 433 | 3 TTGGUACGGUUCACCAGGGUC 5 | | |
| 56 | 57 | ACCAUGCCAAGUGGUCCCAGGCU | AL-DP-4037 | S | 434 | 5 CAUGCCAAGUGGUCCCAGGCU 3 | + | + |
| | | | | AS | 435 | 3 UGGUACGGUUCACCAGGGUCCGA 5 | | |
| | | | AL-DP-4054 | S | 436 | 5 CAUGCCAAGUGGUCCCAGGTT 3 | ++ | + |
| | | | | AS | 437 | 3 TTGUACGGUUCACCAGGGUCC 5 | | |
| 57 | 58 | CCAUGCCAAGUGGUCCCAGGCUG | AL-DP-4038 | S | 438 | 5 AUGCCAAGUGGUCCCAGGCUG 3 | ++ | ++ |
| | | | | AS | 439 | 3 GGUACGGUUCACCAGGGUCCGAC 5 | | |
| | | | AL-DP-4086 | S | 440 | 5 AUGCCAAGUGGUCCCAGGCTT 3 | + | + |
| | | | | AS | 441 | 3 TTACGGUUCACCAGGGUCCG 5 | | |

TABLE 2-continued

| Position in ORF | SEQ ID NO: | Target sequence (5'-3') | Alnylam DUP ID | Strand | SEQ ID NO: | Sequences | Efficacy HeLa | Efficacy hRPE |
|---|---|---|---|---|---|---|---|---|
| 58 | 59 | CAUGCCAAGUGGUCCCAGGCUGC | AL-DP-4049 | S | 442 | 5 UGCCAAGUGGUCCCAGGCUGC 3 | ++ | ++ |
| | | | | AS | 443 | 3 GUACGGUUCACCAGGGUCCGACG 5 | | |
| | | | AL-DP-4087 | S | 444 | 5 UGCCAAGUGGUCCCAGGCUTT 3 | + | + |
| | | | | AS | 445 | 3 TTACGGUUCACCAGGGUCCGA 5 | | |
| 59 | 60 | AUGCCAAGUGGUCCCAGGCUGCA | AL-DP-4001 | S | 446 | 5 GCCAAGUGGUCCCAGGCUGCA 3 | ++ | ++ |
| | | | | AS | 447 | 3 UACGGUUCACCAGGGUCCGACGU 5 | | |
| | | | AL-DP-4052 | A | 448 | 5 GCCAAGUGGUCCCAGGCUGTT 3 | | |
| | | | | AS | 449 | 3 TTCGGUUCACCAGGGUCCGAC 5 | | |
| 60 | 61 | UGCCAAGUGGUCCCAGGCUGCAC | AL-DP-4007 | S | 450 | 5 CCAAGUGGUCCCAGGCUGCAC 3 | +++ | ++ |
| | | | | AS | 451 | 3 ACGGUUCACCAGGGUCCGACGUG 5 | | |
| | | | AL-DP-4088 | S | 452 | 5 CCAAGUGGUCCCAGGCUGCTT 3 | +++ | ++ |
| | | | | AS | 453 | 3 TTGGUUCACCAGGGUCCGACG 5 | | |
| 61 | 62 | GCCAAGUGGUCCCAGGCUGCACC | AL-DP-4070 | S | 454 | 5 CAAGUGGUCCCAGGCUGCACC 3 | ++ | ++ |
| | | | | AS | 455 | 3 CGGUUCACCAGGGUCCGACGUGG 5 | | |
| | | | AL-DP-4055 | S | 456 | 5 CAAGUGGUCCCAGGCUGCATT 3 | +++ | + |
| | | | | AS | 457 | 3 TTGUUCACCAGGGUCCGACGU 5 | | |
| 62 | 63 | CCAAGUGGUCCCAGGCUGCACCC | AL-DP-4071 | S | 458 | 5 AAGUGGUCCCAGGCUGCACCC 3 | + | NA |
| | | | | AS | 459 | 3 GGUUCACCAGGGUCCGACGUGGG 5 | | |
| | | | AL-DP-4056 | S | 460 | 5 AAGUGGUCCCAGGCUGCACTT 3 | ++ | NA |
| | | | | AS | 461 | 3 TTUUCACCAGGGUCCGACGUG 5 | | |
| 63 | 64 | CAAGUGGUCCCAGGCUGCACCCA | AL-DP-4072 | S | 462 | 5 AGUGGUCCCAGGCUGCACCCA 3 | ++ | + |
| | | | | AS | 463 | 3 GUUCACCAGGGUCCGACGUGGGU 5 | | |
| | | | AL-DP-4057 | S | 464 | 5 AGUGGUCCCAGGCUGCACCTT 3 | ++/+ | ++ |
| | | | | AS | 465 | 3 TTCACCAGGGUCCGACGUGG 5 | | |
| 64 | 65 | AAGUGGUCCCAGGCUGCACCCAU | AL-DP-4066 | S | 466 | 5 GUGGUCCCAGGCUGCACCCTT 3 | + | NA |
| | | | | AS | 467 | 3 TTCACCAGGGUCCGACGUGGG 5 | | |
| 99 | 100 | AGGGCAGAAUCAUCACGAAGUGG | AL-DP-4022 | S | 468 | 5 GGCAGAAUCAUCACGAAGUTT 3 | +++ | NA |
| | | | | AS | 469 | 3 TTCCGUCUUAGUAGUGCUUCA 5 | | |
| 100 | 101 | GGGCACAAUCAUCACGAAGUGGU | AL-DP-4023 | S | 470 | 5 GCAGAAUCAUCACGAAGUGTT 3 | ++ | NA |
| | | | | AS | 471 | 3 TTCGUCUUAGUAGUGCUUCAC 5 | | |
| 101 | 102 | GGCAGAAUCAUCACGAAGUGGUG | AL-DP-4024 | S | 472 | 5 CAGAAUCAUCACGAAGUGGTT 3 | + | NA |
| | | | | AS | 473 | 3 TTGUCUUAGUAGUGCUUCACC 5 | | |
| 102 | 103 | GCAGAAUCAUCACGAAGUGGUGA | AL-DP-4076 | S | 474 | 5 AGAAUCAUCACGAAGUGGUGA 3 | ++ | NA |
| | | | | AS | 475 | 3 CGUCUUAGUAGUGCUUCACCACU 5 | | |
| | | | AL-DP-4019 | S | 476 | 5 AGAAUCAUCACGAAGUGGUTT 3 | ++ | NA |
| | | | | AS | 477 | 3 TTUCUUAGUAGUGCUUCACCA 5 | | |
| 103 | 104 | CAGAAUCAUCACGAAGUGGUGAA | AL-DP-4025 | S | 478 | 5 GAAUCAUCACGAAGUGGUGTT 3 | ++ | NA |
| | | | | AS | 479 | 3 TTCUUAGUAGUGCUUCACCAC 5 | | |
| 104 | 105 | AGAAUCAUCACGAAGUGGUGAAG | AL-DP-4110 | S | 480 | 5 AAUCAUCACGAAGUGGUGATT 3 | + | NA |
| | | | | AS | 481 | 3 TTUUAGUAGUGCUUCACCACU 5 | | |
| 105 | 106 | GAAUCAUCACGAAGUGGUGAAGU | AL-DP-4068 | S | 482 | 5 AUCAUCACGAAGUGGUGAATT 3 | + | NA |
| | | | | AS | 483 | 3 TTUAGUAGUGCUUCACCACUU 5 | | |
| 113 | 114 | ACGAAGUGGUGAAGUUCAUGGAU | AL-DP-4078 | S | 484 | 5 GAAGUGGUGAAGUUCAUGGAU 3 | +++ | NA |
| | | | | AS | 485 | 3 UGCUUCACCACUUCAAGUACCUA 5 | | |
| 121 | 122 | GUGAAGUUCAUGGAUGUCUAUCA | AL-DP-4080 | S | 486 | 5 GAAGUUCAUGGAUGUCUAUCA 3 | +++ | NA |
| | | | | AS | 487 | 3 CACUUCAAGUACCUACAGAUAGU 5 | | |
| 129 | 130 | CAUGGAUGUCUAUCAGCGCAGCU | AL-DP-4111 | S | 488 | 5 UGGAUGUCUAUCAGCGCAGTT 3 | +++ | NA |
| | | | | AS | 489 | 3 TTACCUACAGAUAGUCGCGUC 5 | | |
| 130 | 131 | AUGGAUGUCUAUCAGCGCAGCUA | AL-DP-4041 | S | 490 | 5 GGAUGUCUAUCAGCGCAGCUA 3 | +++ | NA |
| | | | | AS | 491 | 3 UACCUACAGAUAGUCGCGUCGAU 5 | | |
| | | | AL-DP-4062 | S | 492 | 5 GGAUGUCUAUCAGCGCAGCTT 3 | +++ | NA |
| | | | | AS | 493 | 3 TTCCUACAGAUAGUCGCGUCG 5 | | |
| 131 | 132 | UGGAUGUCUAUCAGCGCAGCUAC | AL-DP-4069 | S | 494 | 5 GAUGUCUAUCAGCGCAGCUTT 3 | +++ | NA |
| | | | | AS | 495 | 3 TTCUACAGAUAGUCGCGUCGA 5 | | |
| 132 | 133 | GGAUGUCUAUCAGCGCAGCUACU | AL-DP-4112 | S | 496 | 5 AUGUCUAUCAGCGCAGCUATT 3 | + | NA |
| | | | | AS | 497 | 3 TTACAGAUAGUCGCGUCGAU 5 | | |

TABLE 2-continued

| Position in ORF | SEQ ID NO: | Target sequence (5'-3') | Alnylam DUP ID | Strand | SEQ ID NO: | Sequences | Efficacy HeLa | Efficacy hRPE |
|---|---|---|---|---|---|---|---|---|
| 133 | 134 | GAUGUCUAUCAGCGCAGCUACUG | AL-DP-4026 | S | 498 | 5 UGUCUAUCAGCGCAGCUACUTT 3 | ++ | NA |
| | | | | AS | 499 | 3 TTACAGAUAGUCGCGUCGAUG 5 | | |
| 134 | 135 | AUGUCUAUCAGCGCAGCUACUGC | AL-DP-4095 | S | 500 | 5 GUCUAUCAGCGCAGCUACUGC 3 | +++ | NA |
| | | | | AS | 501 | 3 UACAGAUAGUCGCGUCGAUGACG 5 | | |
| | | | AL-DP-4020 | S | 502 | 5 GUCUAUCAGCGCAGCUACUTT 3 | +++ | NA |
| | | | | AS | 503 | 3 TTCAGAEJAGEJCGCGUCGAUGA 5 | | |
| 135 | 136 | UGUCUAUCAGCGCAGCUACUGCC | AL-DP-4027 | S | 504 | 5 UCUAUCAGCGCAGCUACUGTT 3 | + | NA |
| | | | | AS | 505 | 3 TTAGAUAGUCGCGUCGAUGAC 5 | | |
| 144 | 145 | GCGCAGCUACUGCCAUCCAAUCG | AL-DP-4081 | S | 506 | 5 GCAGCUACUGCCAUCCAAUCG 3 | +++ | NA |
| | | | | AS | 507 | 3 CGCGUCGAUGACGGUAGGUUAGC 5 | | |
| 146 | 147 | GCAGCUACUGCCAUCCAAUCGAG | AL-DP-4098 | S | 508 | 5 AGCUACUGCCAUCCAAUCGAG 3 | +++ | NA |
| | | | | AS | 509 | 3 CGUCGAUGACGGUAGGUUAGCUC 5 | | |
| 149 | 150 | GCUACUGCCAUCCAAUCGAGACC | AL-DP-4028 | S | 510 | 5 UACUGCCAUCCAAUCGAGATT 3 | ++ | NA |
| | | | | AS | 511 | 3 TTAUGACGGUAGGUUAGCUCU 5 | | |
| 150 | 151 | CUACUGCCAUCCAAUCGAGACCC | AL-DP-4029 | S | 512 | 5 ACUGCCAUCCAAUCGAGACTT 3 | + | NA |
| | | | | AS | 513 | 3 TTUGACGGUAGGUUAGCUCUG 5 | | |
| 151 | 152 | UACUGCCAUCCAAUCGAGACCCU | AL-DP-4030 | S | 514 | 5 CUGCCAUCCAAUCGAGACCTT 3 | +++ | NA |
| | | | | AS | 515 | 3 TTGACGGUAGGUUAGCUCUGG 5 | | |
| 152 | 153 | ACUGCCAUCCAAUCGAGACCCUG | AL-DP-4031 | S | 516 | 5 UGCCAUCCAAUCGAGACCCTT 3 | + | NA |
| | | | | AS | 517 | 3 TTACGGUAGGUUAGCUCUGGG 5 | | |
| 166 | 167 | GAGACCCUGGUGGACAUCUUCCA | AL-DP-4008 | S | 518 | 5 GACCCUGGUGGACAUCUUCCA 3 | ++ | + |
| | | | | AS | 519 | 3 CUCUGGGACCACCUGUAGAAGGU 5 | | |
| | | | AL-DP-4058 | S | 520 | 5 GACCCUGGUGGACAUCUUCTT 3 | ++ | ++ |
| | | | | AS | 521 | 3 TTCUGGGACCACCUGUAGAAG 5 | | |
| 167 | 168 | AGACCCUGGUGGACAUCUUCCAG | AL-DP-4009 | S | 522 | 5 ACCCUGGUGGACAUCUUCCAG 3 | ++ | NA |
| | | | | AS | 523 | 3 UCUGGGACCACCUGUAGAAGGUC 5 | | |
| | | | AL-DP-4059 | S | 524 | 5 ACCCUGGUGGACAUCUUCTT 3 | + | NA |
| | | | | AS | 525 | 3 TTUGGGACCACCUGUAGAAGG 5 | | |
| 168 | 169 | GACCCUGGUGGACAUCUUCCAGG | AL-DP-4010 | S | 526 | 5 CCCUGGUGGACAUCUUCCAGG 3 | + | + |
| | | | | AS | 527 | 3 CUGGGACCACCUGUAGAAGGUCC 5 | | |
| | | | AL-DP-4060 | S | 528 | 5 CCCUGGUGGACAUCUUCCATT 3 | +++ | ++ |
| | | | | AS | 529 | 3 TTGGGACCACCUGUAGAAGGU 5 | | |
| 169 | 170 | ACCCUGGUGGACAUCUUCCAGGA | AL-DP-4073 | S | 530 | 5 CCUGGUGGACAUCUUCCAGGA 3 | ++ | + |
| | | | | AS | 531 | 3 UGGGACCACCUGUAGAAGGUCCU 5 | | |
| | | | AL-DP-4104 | S | 532 | 5 CCUGGUGGACAUCUUCCAGTT 3 | +++/+ | ++ |
| | | | | AS | 533 | 3 TTGGACCACCUGUAGAAGGUC 5 | | |
| 170 | 171 | CCCUGGUGGACAUCUUCCAGGAG | AL-DP-4011 | S | 534 | 5 CUGGUGGACAUCUUCCAGGAG 3 | + | NA |
| | | | | AS | 535 | 3 GGGACCACCUGUAGAAGGUCCUC 5 | | |
| | | | AL-DP-4089 | S | 536 | 5 CUGGUGGACAUCUUCCAGGTT 3 | + | NA |
| | | | | AS | 537 | 3 TTGACCACCUGUAGAAGGUCC 5 | | |
| 171 | 172 | CCUGGUGGACAUCUUCCAGGAGU | AL-DP-4074 | S | 538 | 5 UGGUGGACAUCUUCCAGGAGU 3 | ++ | + |
| | | | | AS | 539 | 3 GGACCACCUGUAGAAGGUCCUCA 5 | | |
| | | | AL-DP-4090 | S | 540 | 5 UGGUGGACAUCUUCCAGGATT 3 | ++ | ++ |
| | | | | AS | 541 | 3 TTACCACCUGUAGAAGGUCCU 5 | | |
| 172 | 173 | CUGGUGGACAUCUUCCAGGAGUA | AL-DP-4039 | S | 542 | 5 GGUGGACAUCUUCCAGGAGUA 3 | ++ | ++ |
| | | | | AS | 543 | 3 GACCACCUGUAGAAGGUCCUCAU 5 | | |
| | | | AL-DP-4091 | S | 544 | 5 GGUGGACAUCUUCCAGGAGTT 3 | + | + |
| | | | | AS | 545 | 3 TTCCACCUGUAGAAGGUCCUC 5 | | |
| 175 | 176 | GUGGACAUCUUCCAGGAGUACCC | AL-DP-4003 | S | 546 | 5 GGACAUCUUCCAGGAGUACCC 3 | ++ | ++ |
| | | | | AS | 547 | 3 CCUGUAGAAGGUCCUCAUGGG 5 | | |
| | | | AL-DP-4116 | S | 548 | 5 GGACAUCUUCCAGGAGUACCC 3 | + | NA |
| | | | | AS | 549 | 3 CCUGUAGAAGGUCCUCAUGGG 5 | | |
| | | | AL-DP-4015 | S | 550 | 5 GGACAUCUUCCAGGAGUACTT 3 | ++ | ++ |
| | | | | AS | 551 | 3 TTCCUGUAGAAGGUCCUCAUG 5 | | |
| | | | AL-DP-4120 | S | 552 | 5 GGACAUCUUCCAGGAGUAC 3 | + | NA |
| | | | | AS | 553 | 3 CCUGUAGAAGGUCCUCAUG 5 | | |
| 179 | 180 | ACAUCUUCCAGGAGUACCCUGAU | AL-DP-4099 | S | 554 | 5 AUCUUCCAGGAGUACCCUGAU 3 | +++ | NA |
| | | | | AS | 555 | 3 UGUAGAAGGUCCUCAUGGGACUA 5 | | |

TABLE 2-continued

| Position in ORF | SEQ ID NO: | Target sequence (5'-3') | Alnylam DUP ID | Strand | SEQ ID NO: | Sequences | Efficacy HeLa | Efficacy hRPE |
|---|---|---|---|---|---|---|---|---|
| 191 | 192 | AGUACCCUGAUGAGAUCGAGUAC | AL-DP-4032 | S | 556 | 5 UACCCUGAUGAGAUCGAGUTT 3 | +++ | NA |
|  |  |  |  | AS | 557 | 3 TTAUGGGACUACUCUAGCUCA 5 |  |  |
| 192 | 193 | GUACCCUGAUGAGAUCGAGUACA | AL-DP-4042 | S | 558 | 5 ACCCUGAUGAGAUCGAGUACA 3 | +++ | NA |
|  |  |  |  | AS | 559 | 3 CAUGGGACUACUCUAGCUCAUGU 5 |  |  |
|  |  |  | AL-DP-4063 | S | 560 | 5 ACCCUGAUGAGAUCGAGUATT 3 | +++ | NA |
|  |  |  |  | AS | 561 | 3 TTUGGGACUACUCUAGCUCAU 5 |  |  |
| 209 | 210 | AGUACAUCUUCAAGCCAUCCUGU | AL-DP-4064 | S | 562 | 5 UACAUCUUCAAGCCAUCCUTT 3 | + | NA |
|  |  |  |  | AS | 563 | 3 TTAUGUAGAAGUUCGGUAGGA 5 |  |  |
| 260 | 261 | GCAAUGACGAGGGCCUGGAGUGU | AL-DP-4044 | S | 564 | 5 AAUGACGAGGGCCUGGAGUGU 3 | + | NA |
|  |  |  |  | AS | 565 | 3 CGUUACUGCUCCCGGACCUCACA 5 |  |  |
| 263 | 264 | AUGACGAGGGCCUGGAGUGUGUG | AL-DP-4045 | S | 566 | 5 GACGAGGGCCUGGAGUGUGUG 3 | + | NA |
|  |  |  |  | AS | 567 | 3 UACUGCUCCCGGACCUCACACAC 5 |  |  |
| 279 | 280 | GUGUGUGCCCACUGAGGAGUCCA | AL-DP-4046 | S | 568 | 5 GUGUGCCCACUGAGGAGUCCA 3 | +++ | NA |
|  |  |  |  | AS | 569 | 3 CACACACGGGUGACUCCUCAGGU 5 |  |  |
| 281 | 282 | GUGUGCCCACUGAGGAGUCCAAC | AL-DP-4096 | S | 570 | 5 GUGCCCACUGAGGAGUCCAAC 3 | +++ | NA |
|  |  |  |  | AS | 571 | 3 CACACGGGUGACUCCUCAGGUUG 5 |  |  |
| 283 | 284 | GUGCCCACUGAGGAGUCCAACAU | AL-DP-4040 | S | 572 | 5 GCCCACUGAGGAGUCCAACAU 3 | +++ | NA |
|  |  |  |  | AS | 573 | 3 CACGGGUGACUCCUCAGGUUGUA 5 |  |  |
| 289 | 290 | ACUGAGGAGUCCAACAUCACCAU | AL-DP-4065 | S | 574 | 5 UGAGGAGUCCAACAUCACCTT 3 | + | NA |
|  |  |  |  | AS | 575 | 5 TTACUCCUCAGGUUGUAGUGG 5 |  |  |
| 302 | 303 | ACAUCACCAUGCAGAUUAUGCGG | AL-DP-4100 | S | 576 | 5 AUCACCAUGCAGAUUAUGCGG 3 | ++ | NA |
|  |  |  |  | AS | 577 | 3 UGUAGUGGUACGUCUAAUACGCC 5 |  |  |
| 305 | 306 | UCACCAUGCAGAUUAUGCGGAUC | AL-DP-4033 | S | 578 | 5 ACCAUGCAGAUUAUGCGGATT 3 | ++ | NA |
|  |  |  |  | AS | 579 | 3 TTUGGUACGUCUAAUACGCCU 5 |  |  |
| 310 | 311 | AUGCAGAUUAUGCGGAUCAAACC | AL-DP-4101 | S | 580 | 5 GCACAUUAUCCCGAUCAAACC 3 | +++ | NA |
|  |  |  |  | AS | 581 | 3 UACGUCUAAUACGCCUAGUUUGG 5 |  |  |
| 312 | 313 | GCAGAUUAUGCGGAUCAAACCUC | AL-DP-4102 | S | 582 | 5 AGAUUAUGCGGAUCAAACCUC 3 | +++ | NA |
|  |  |  |  | AS | 583 | 3 CGUCUAAUACGCCUAGUUUGGAG 5 |  |  |
| 315 | 316 | GAUUAUGCGGAUCAAACCUCACC | AL-DP-4034 | S | 584 | 5 UUAUGCGGAUCAAACCUCATT 3 | ++ | NA |
|  |  |  |  | AS | 585 | 3 TTAAUACGCCUAGUUUGGAGU 5 |  |  |
| 316 | 317 | AUUAUGCGGAUCAAACCUCACCA | AL-DP-4113 | S | 586 | 5 UAUGCGGAUCAAACCUCACTT 3 | ++ | NA |
|  |  |  |  | AS | 587 | 3 TTAUACGCCUAGUUUGGAGUG 5 |  |  |
| 317 | 318 | UUAUGCGGAUCAAACCUCACCAA | AL-DP-4114 | S | 588 | 5 AUGCGGAUCAAACCUCACCTT 3 | + | NA |
|  |  |  |  | AS | 588 | 3 TTUACGCCUAGUUUGGAGUGG 5 |  |  |
| 319 | 320 | AUGCGGAUCAAACCUCACCAAGG | AL-DP-4002 | S | 590 | 5 GCGGAUCAAACCUCACCAAGG 3 | +++ | +++ |
|  |  |  |  | AS | 591 | 3 UACGCCUAGUUUGGAGUGGUUCC 5 |  |  |
|  |  |  | AL-DP-4115 | S | 592 | 5 GCGGAUCAAACCUCACCAA 3 | +++ | NA |
|  |  |  |  | AS | 593 | 3 CGCCUAGUUUGGAGUGGUU 5 |  |  |
|  |  |  | AL-DP-4014 | S | 594 | 5 GCGGAUCAAACCUCACCAATT 3 | +++ | +++ |
|  |  |  |  | AS | 595 | 3 TTCGCCUAGUUUGGAGUGGUU 5 |  |  |
|  |  |  | AL-DP-4119 | S | 596 | 5 GCGGAUCAAACCUCACCAA 3 | +++ | NA |
|  |  |  |  | AS | 597 | 3 CGCCUAGUUUGGAGUGGUU 5 |  |  |
| 321 | 322 | GCGGAUCAAACCUCACCAAGGCC | AL-DP-4013 | S | 598 | 5 GGAUCAAACCUCACCAAGGCC 3 | ++ | NA |
|  |  |  |  | AS | 599 | 3 CGCCUAGUUUGGAGUGGUUCCGG 5 |  |  |
| 341 | 342 | GCCAGCACAUAGGAGAGAUGAGC | AL-DP-4075 | S | 600 | 5 CAGCACAUAGGAGAGAUGAGC 3 | +++ | ++ |
|  |  |  |  | AS | 601 | 3 CGGUCGUGUAUCCUCUCUACUCG 5 |  |  |
|  |  |  | AL-DP-4105 | S | 602 | 5 CAGCACAUAGGAGAGAUGATT 3 | ++ | ++ |
|  |  |  |  | AS | 603 | 3 TTGUCGUGUAUCCUCUCUACU 5 |  |  |
| 342 | 343 | CCAGCACAUAGGAGAGAUGAGCU | AL-DP-4050 | S | 604 | 5 AGCACAUAGGAGAGAUGAGCU 3 | +++ | +++ |
|  |  |  |  | AS | 605 | 3 GGUCGUGUAUCCUCUCUACUCCA 5 |  |  |
|  |  |  | AL-DP-4106 | S | 606 | 5 AGCACAUAGGAGAGAUGAGTT 3 | ++ | +++ |
|  |  |  |  | AS | 607 | 3 TTUCGUGUAUCCUCUCUACUC 5 |  |  |
| 343 | 344 | CAGCACAUAGGAGAGAUGAGCUU | AL-DP-4094 | S | 608 | 5 GCACAUAGGAGAGAUGAGCUU 3 | +++ | +++ |
|  |  |  |  | AS | 609 | 3 GUCGUGUAUCCUCUCUACUCGAA 5 |  |  |

TABLE 2-continued

| Position in ORF | SEQ ID NO: | Target sequence (5'-3') | Alnylam DUP ID | Strand | SEQ ID NO: | Sequences | Efficacy HeLa | Efficacy hRPE |
|---|---|---|---|---|---|---|---|---|
| | | | AL-DP-4118 | S | 610 | 5 GCACAUAGGAGAGAUGAGCUUU 3 | * | NA |
| | | | | AS | 611 | 3 CGUGUAUCCUCUCUACUCGAA 5 | | |
| | | | AL-DP-4107 | S | 612 | 5 GCACAUAGGAGAGAUGAGCTT 3 | +++ | +++ |
| | | | | AS | 613 | 3 TTCGUGUAUCCUCUCUACUCG 5 | | |
| | | | AL-DP-4122 | S | 614 | 5 GCACAUAGGAGAGAUGAGC 3 | ++ | NA |
| | | | | AS | 615 | 3 CGUGUAUCCUCUCUACUCG 5 | | |
| 344 | 345 | AGCACAUAGGAGAGAUGAGCUUC | AL-DP-4012 | S | 616 | 5 CACAUAGGAGAGAUCAGCUUC 3 | +++ | +++ |
| | | | | AS | 617 | 3 UCGUGUAUCCUCUCUACUCGAAG 5 | | |
| | | | AL-DP-4108 | S | 618 | 5 CACAUAGGAGAGAUGAGCUTT 3 | +++ | +++ |
| | | | | AS | 619 | 3 TTGUGUAUCCUCUCUACUCGA 5 | | |
| 346 | 347 | CACAUAGGAGAGAUGAGCUUCCU | AL-DP-4051 | S | 620 | 5 CAUAGGAGAGAUGAGCCUUCCU 3 | +++ | +++ |
| | | | | AS | 621 | 3 GUGUAUCCUCUCUACUCGAAGGA 5 | | |
| | | | AL-DP-4061 | S | 622 | 5 CAUAGGAGAGAUGAGCUUCTT 3 | +++ | +++ |
| | | | | AS | 623 | 3 TTGUAUCCUCUCUACUCGAAG 5 | | |
| 349 | 350 | AUAGGAGAGAUGAGCUUCCUACA | AL-DP-4082 | S | 624 | 5 AGGAGAGAUGAGCUUCCUACA 3 | +++ | NA |
| | | | | AS | 625 | 3 UAUCCUCUCUACUCGAAGGAUGU 5 | | |
| 369 | 370 | ACAGCACAACAAAUGUGAAUGCA | AL-DP-4079 | S | 626 | 5 AGCACAACAAAUGUGAAUGCA 3 | ++ | NA |
| | | | | AS | 627 | 3 UGUCGUGUUGUUUACACUUACGU 5 | | |
| 372 | 373 | GCACAACAAAUGUGAAUGCAGAC | AL-DP-4097 | S | 628 | 5 ACAACAAAUGUGAAUGCAGAC 3 | ++ | NA |
| | | | | AS | 629 | 3 CGUGUUGUUUACACUUACGUCUG 5 | | |
| 379 | 380 | AAAUGUGAAUGCAGACCAAAGAA | AL-DP-4067 | S | 630 | 5 AUGUGAAUGCAGACCAAAGTT 3 | ++ | NA |
| | | | | AS | 631 | 3 TTUACACUUACGUCUGGUUUC 5 | | |
| 380 | 381 | AAUGUGAAUGCAGACCAAAGAAA | AL-DP-4092 | S | 632 | 5 UGUGAAUGCAGACCAAAGAUT 3 | +++ | NA |
| | | | | AS | 633 | 3 TTACACUUACGUCUGGUUUCU 5 | | |
| 381 | 382 | AUGUGAAUGCAGACCAAAGAAAG | AL-DP-4004 | S | 634 | 5 GUGAAUGCAGACCAAAGAAAG 3 | +++ | ++ |
| | | | | AS | 635 | 3 UACACUUACGUCUGGUUUCUUUC 5 | | |
| | | | AL-DP-4117 | S | 636 | 5 GUGAAUGCAGACCAAAGAAAG 3 | +++ | NA |
| | | | | AS | 637 | 3 CACUUACGUCUGGUUUCUUUC 5 | | |
| | | | AL-DP-4016 | S | 638 | 5 GUGAAUGCAGACCAAAGAATT 3 | +++ | +++ |
| | | | | AS | 639 | 3 TTCACUUACGUCUGGUUUCUU 5 | | |
| | | | AL-DP-4121 | S | 640 | 5 GUGAAUGCAGACCAAAGAA 3 | ++ | NA |
| | | | | AS | 641 | 3 CACUUACGUCUGGUUUCUU 5 | | |
| 383 | 384 | GUGAAUGCAGACCAAAGAAAGAU | AL-DP-4005 | S | 642 | 5 GAAUGCAGACCAAAGAAAGAU 3 | +++ | ++ |
| | | | | AS | 643 | 3 CACUUACGUCUGGUUUCUUUCUA 5 | | |
| | | | AL-DP-4053 | S | 644 | 5 GAAUGCAGACCAAAGAAAGTT 3 | +++ | ++ |
| | | | | AS | 645 | 3 TTCUUACGUCUGCUUUCUUUC 5 | | |

TABLE 3

Phosphorothioate stabilized siRNA Molecules are modified versions of AL-DP-4014.

| ORF Position | Aln Duplex # | Duplex Sequence | SEQ ID NOs | Efficacy |
|---|---|---|---|---|
| 319 | ALN-DP-4127 | 5'-G*C*GGAUCAAACCUCACCA*A*dT*dT-3'<br>3'-dT*dT*C*GCCUAGUUUGGAGUGG*U*U-5' | 646<br>647 | +++ |
| 319 | ALN-DP-4128 | 5'-G*C*GGAUCAAACCUC*ACC*A*A*dT*dT-3'<br>3'-dT*dT*CGCCUAGUUUGGAGUGGU*U-5' | 648<br>649 | +++ |
| 319 | ALN-DP-4129 | 5'-G*C*GGAUCAAACCUC*ACC*A*A*dT*dT-3'<br>3'-dT*dT*C*GCCUAGUUUGGAGUGG*U*U-5' | 650<br>651 | +++ |

*indicates the position of a phosphorothioate group

TABLE 4

In vitro efficacy of Modified AL-DP-4094 series

| SIRNA | | Efficacy | 5'-sense strand-3'<br>3'-antisense strand-5' | SEQ ID NOs |
|---|---|---|---|---|
| AL-DP-4198 | AL4554<br>AL4557 | +++ | 5'-GsCACAUAGGAGAGAUGAGCUsU-3'<br>'3-GsUCGUGUAUCCUCUCUACUCGAsA-'5 | 652<br>653 |
| AL-DP-4165 | AL4554<br>AL4558 | +++ | 5'-GsCACAOAGGAGAGAUGAGCUsU-3<br>'3-GsU$_{OMe}$C$_{OMe}$GUGUAUCCUCUCUACUGAsA-'5 | 652<br>654 |
| AL-DP-4166 | AL4554<br>AL4559 | +++ | 5'-GsCACAUAGGAGAGAUGAGCUsU-3'<br>'3-GsU$_{OMe}$C$_{OMe}$GUGUAU$_{OMe}$CCUCUCUACUCGAsA-'5 | 652<br>655 |
| AL-DP-4167 | AL4554<br>AL4560 | +++ | 5'-GsCACAUAGGAGAGAUGAGCUsU-3'<br>'3-GsU$_{OMe}$CGU$_{OMe}$GU$_{OMe}$AU$_{OMe}$CCUCUCUAC$_{OMe}$UCGAA-'5 | 652<br>656 |
| AL-DP-4168 | AL4554<br>AL4561 | +++ | 5'-GsCACAUAGGAGAGAUGAGCUsU-3'<br>'3-GsU$_{OMe}$C$_{OMe}$GU$_{OMe}$GU$_{OMe}$AU$_{OMe}$CCUCUCUAC$_{OMe}$UCGAA-'5 | 652<br>657 |
| AL-DP-4169 | AL4554<br>AL4562 | +++ | 5'-GsCACAUAGGAGAGAUGAGCUsU-3'<br>'3-GsU$_{OMe}$dCGU$_{OMe}$GU$_{OMe}$AU$_{OMe}$CCUCUCUAdCUCGAA-'5 | 652<br>658 |
| AL-DP-4170 | AL4555<br>AL4557 | +++ | 5'-GsCACAU$_{2',OMe}$AGGAGACAUCAGCUsU-3'<br>'3-GsUCGUGUAUCCUCUCUACUCGAsA-'5 | 659<br>653 |
| AL-DP-4171 | AL4555<br>AL4558 | +++ | 5'-GsCACAU$_{2',OMe}$AGGAGAGAUGAGCUsU-3'<br>'3-GsU$_{OMe}$C$_{OMe}$GUGUAUCCUCUCUACUGAsA-'5 | 659<br>654 |
| AL-DP-4172 | AL4555<br>AL4559 | +++ | 5'-GsCACAU$_{2',OMe}$AGGAGAGAUGAGCUsU-3'<br>'3-GsU$_{OMe}$C$_{OMe}$GUGUAU$_{OMe}$CCUCUCUACUGAsA-'5 | 659<br>655 |
| AL-DP-4173 | AL4555<br>AL4560 | +++ | 5'-GsCACAU$_{2',OMe}$AGGAGAGAUGAGCUsU-3'<br>'3-GsU$_{OMe}$CGU$_{OMe}$GU$_{OMe}$AU$_{OMe}$CCUCUCUAC$_{OMe}$UCGAA-'5 | 659<br>656 |
| AL-DP-4174 | AL4555<br>AL4561 | +++ | 5'-GsCACAU$_{2',OMe}$AGGAGAGAUGAGCUsU-3'<br>'3-GsU$_{OMe}$C$_{OMe}$GU$_{OMe}$GU$_{OMe}$AU$_{OMe}$CCUCUCUAC$_{OMe}$UCGAA-'5 | 659<br>657 |
| AL-DP-4175 | AL4555<br>AL4562 | +++ | 5'-GsCACAU$_{2',OMe}$AGGAGAGAUGAGCUsU-3'<br>'3-GsU$_{OMe}$dCGU$_{OMe}$GU$_{OMe}$AU$_{OMe}$CCUCUCUAdCUCGAA-'5 | 659<br>658 |
| AL-DP-4176 | AL4556<br>AL4557 | +++ | 5'-GC$_{OMe}$AC$_{OMe}$AU$_{OMe}$AGGAGAGAU$_{OMe}$GAGCU$_{OMe}$sU-3'<br>'3-GsUCGUGUAUCCUCUCUACUCGAsA-'5 | 660<br>653 |
| AL-DP-4177 | AL4556<br>AL4558 | +++ | 5'-GC$_{OMe}$AC$_{OMe}$AU$_{OMe}$AGGAGAGAU$_{OMe}$GAGCU$_{OMe}$sU-3'<br>'3-GsU$_{OMe}$C$_{OMe}$GUGUAUCCUCUCUACUGAsA-'5 | 660<br>654 |
| AL-DP-4178 | AL4556<br>AL4559 | +++ | 5'-GC$_{OMe}$AC$_{OMe}$AU$_{OMe}$AGGAGAGAU$_{OMe}$GAGCU$_{OMe}$sU-3'<br>'3-GsU$_{OMe}$C$_{OMe}$GUGUAU$_{OMe}$CCUCUCUACUGAsA-5' | 660<br>655 |
| AL-DP-4179 | AL4556<br>AL4560 | +++ | 5'-GC$_{OMe}$AC$_{OMe}$AU$_{OMe}$AGGAGAGAU$_{OMe}$GAGCU$_{OMe}$sU-3'<br>'3-GsU$_{OMe}$CGU$_{OMe}$GU$_{OMe}$AU$_{OMe}$CCUCUCUAC$_{OMe}$UCGAA-'5 | 660<br>656 |
| AL-DP-4180 | AL4556<br>AL4561 | +++ | 5'-GC$_{OMe}$AC$_{OMe}$AU$_{OMe}$AGGAGAGAU$_{OMe}$GAGCU$_{OMe}$sU-3'<br>'3-GsU$_{OMe}$C$_{OMe}$GU$_{OMe}$GU$_{OMe}$AU$_{OMe}$CCUCUCUAC$_{OMe}$UCGAA-'5 | 660<br>657 |
| AL-DP-4181 | AL4556<br>AL4562 | +++ | 5'-GC$_{OMe}$AC$_{OMe}$AU$_{OMe}$AGGAGAGAU$_{OMe}$GAGCU$_{OMe}$sU-3'<br>'3-GsU$_{OMe}$dCGU$_{OMe}$GU$_{OMe}$AU$_{OMe}$CCUCUCUAdCUCGAA-'5 | 660<br>658 |
| AL-DP-4220 | AL2780<br>AL2781 | +++ | 5'-GsC$_{OMe}$AC$_{OMe}$AU$_{OMe}$AGGAGAGAU$_{OMe}$GAGCU$_{OMe}$sU-3'<br>'3-GsU$_{OMe}$C$_{OMe}$GU$_{OMe}$GU$_{OMe}$AU$_{OMe}$CCUCUCUAC$_{OMe}$UCGAsA-'5 | 660<br>657 |
| AL-DP-4182 | AL4563<br>AL4557 | +++ | 5'-G dC A dC AU$_{OMe}$AGGAGAGAU$_{OMe}$GAGCU$_{OMe}$sU-3'<br>'3-GsUCGUGUAUCCUCUCUACUCGAsA-'5 | 661<br>653 |
| AL-DP-4183 | AL4563<br>AL4558 | +++ | 5'-G dC A dC AU$_{OMe}$AGGAGAGAU$_{OMe}$GAGCU$_{OMe}$sU-3'<br>'3-GsU$_{OMe}$C$_{OMe}$GUGUAUCCUCUCUACUGAsA-'5 | 663<br>654 |
| AL-DP-4184 | AL4563<br>AL4559 | +++ | 5'-G dC A dC AU$_{OMe}$AGGAGAGAU$_{OMe}$GAGCU$_{OMe}$sU-3'<br>'3-GsU$_{OMe}$C$_{OMe}$GUGUAU$_{OMe}$CCUCUCUACUGAsA-'5 | 661<br>655 |
| AL-DP-4185 | AL4563<br>AL4560 | +++ | 5'-G dC A dC AU$_{OMe}$AGGAGAGAU$_{OMe}$GAGCU$_{OMe}$sU-3'<br>'3-GsU$_{OMe}$CGU$_{OMe}$GU$_{OMe}$AU$_{OMe}$CCUCUCUAC$_{OMe}$UCGAA-'5 | 661<br>656 |
| AL-DP-4186 | AL4563<br>AL4561 | +++ | 5'-G dC A dC AU$_{OMe}$AGGAGAGAU$_{OMe}$GAGCU$_{OMe}$sU-3'<br>'3-GsU$_{OMe}$C$_{OMe}$GU$_{OMe}$GU$_{OMe}$AU$_{OMe}$CCUCUCUAC$_{OMe}$UCGAA-5' | 661<br>657 |
| AL-DP-4187 | AL4563<br>AL4562 | +++ | 5'-G dC A dC AU$_{OMe}$AGGAGAGAU$_{OMe}$GAGCU$_{OMe}$sU-3'<br>'3-GsU$_{OMe}$dCGU$_{OMe}$GU$_{OMe}$AU$_{OMe}$CCUCUCUAdCUCGAA-'5 | 661<br>658 |
| AL-DP-4188 | AL4564<br>AL4557 | +++ | 5'-GsCACAU$_F$AGGAGAGAUGAGCUsU-3'<br>'3-GsUCGUGUAUCCUCUCUACUCGAsA-'5 | 662<br>653 |
| AL-DP-4189 | AL4565<br>AL4557 | +++ | 5'-GC$_F$AC$_F$AU$_F$AGGAGAGAU$_F$GAGCU$_F$sU-3'<br>'3-GsUCGUGUAUCCUCUCUACUCGAsA-'5 | 663<br>653 |
| AL-DP-4190 | AL4566<br>AL4557 | +++ | 5'-GC$_F$AC$_F$AU$_{OMe}$AGGAGAGAU$_{OMe}$GAGCU$_{OMe}$sU-3'<br>'3-GsUCGUGUAUCCUCUCUACUCGAsA-'5 | 664<br>653 |
| AL-DP-4191 | AL4567<br>AL4557 | +++ | 5'-GC$_{OMe}$AC$_{OMe}$AU$_F$AGGAGAGAU$_F$GAGCU$_F$sU-3'<br>'3-GsUCGUGUAUCCUCUCUACUCGAsA-'5 | 665<br>653 |
| AL-DP-4192 | AL4554<br>AL4568 | +++ | 5'-GsCACAUAGGAGAGAUGAGCUsU-3'<br>'3-GsU$_F$CGU$_F$GU$_F$AU$_F$CCUCUCUAC$_F$UCGAA-'5 | 652<br>666 |
| AL-DP-4193 | AL4554<br>AL4569 | +++ | 5'-GsCACAUAGGAGAGAUGAGCUsU-3'<br>'3-GsU$_F$CGU$_F$GU$_F$AU$_F$CCUCUCUAC$_{OMe}$UCGAA-'5 | 652<br>667 |
| AL-DP-4194 | AL4554<br>AL4570 | +++ | 5'-GsCACAUAGGAGAGAUGAGCUsU-3'<br>'3-GsU$_{OMe}$CGU$_{OMe}$GU$_{OMe}$AU$_{OMe}$CCUCUCUAC$_F$UCGAA-'5 | 652<br>668 |
| AL-DP-4197 | AL4556<br>AL4568 | ND | 5'-GC$_{OMe}$AC$_{OMe}$AU$_{OMe}$AGGAGAGAU$_{OMe}$GAGCU$_{OMe}$sU-3'<br>'3-GsU$_F$CGU$_F$GU$_F$AU$_F$CCUCUCUAC$_F$UCGAA-'5 | 660<br>666 |
| AL-DP-4221 | AL2780<br>AL2782 | +++ | 5'-GsC$_{OMe}$AC$_{OMe}$AU$_{OMe}$AGGAGAGAU$_{OMe}$GAGCU$_{OMe}$sU-3'<br>'3-GsU$_F$CGU$_F$GU$_F$AU$_F$CCUCUCUAC$_F$UCGAA-'5 | 669<br>670 |

"Atugen Design" based on single overhang

TABLE 4-continued

In vitro efficacy of Modified AL-DP-4094 series

| SIRNA | | Efficacy | 5'-sense strand-3'<br>3'-antisense strand-5' | SEQ ID NOs |
|---|---|---|---|---|
| AL-DP-4195 | AL4571 | + | 5'-GcAcAuAgGaGaGaUgAgCusU-3' | 671 |
| | AL4572 | | '3-gsUcGuGuAuCcUcUcuaCucgAa-'5 | 672 | d deoxynucleotide
OMe 2'-O-Methyl
F 2'Flouro
s phosphorothioate linkage
N Mismatches in scrambled controls

TABLE 5

In vitro efficacy of siRNAs in HeLa cells

| siRNA | Unmodified parent | Strand # | Efficacy | 5'-sense strand-3'<br>3'-antisense strand-5' | SEQ ID NOs |
|---|---|---|---|---|---|
| AL-DP-4374 | AL-DP-4055 | AL2732 | +++ | 5' CsAAGUGGUCCCAGGCUGCATsT 3' | 673 |
| | | AL2740 | | 3' TsTGUUCACCAGGGUCCGACGsU 5' | 674 |
| AL-DP-4375 | AL-DP-4015 | AL2728 | +++ | 5' GsGACAUCUUCCACGAGUACTsT 3' | 675 |
| | | AL2730 | | 3' TsTCCUGUAGAAGGUCCUCAUsG 5' | 676 |
| AL-DP-4379 | AL-DP-4088 | AL2963 | +++ | 5' C$_{OMe}$C$_{OMe}$AAGU$_{OMe}$GGU$_{OMe}$C$_{OMe}$C$_{OMe}$C$_{OMe}$AGGC$_{OMe}$U$_{OMe}$GCoMeTsT 3' | 677 |
| | | AL2964 | | 3' TsTGGU$_F$U$_F$C$_F$AC$_F$C$_F$AGGGU$_F$C$_F$C$_F$GAC$_F$G 5' | 678 |
| AL-DP-4380 | AL-DP-4014 | AL2966 | +++ | 5' GC$_{OMe}$GGAU$_{OMe}$C$_{OMe}$AAAC$_{OMe}$C$_{OMe}$U$_{OMe}$C$_{OMe}$AC$_{OMe}$C$_{OMe}$AATsT 3' | 679 |
| | | AL2967 | | 3' 'TsTC$_F$GC$_F$C$_F$U$_F$AGU$_F$U$_F$U$_F$GGAGU$_F$GGU$_F$U$_F$5' | 680 |
| AL-DP-4219 | AL-DP-4004 | AL2712 | +++ | 5' GsUGAAUGCAGACCAAAGAAAsG 3' | 681 |
| | | AL2720 | | 3' UsACACUUACGUCUGGUUUCUUUsC 5' | 682 |
| AL-DP-4140 | AL-DP-4014 | AL2281 | − | 5' GsCsGGAACAAUCCUGACCAsAsTsT 3' | 683 |
| | | AL2282 | | 3' TsTCGCCUUGUUAGGACUGGsUsU 3' | 684 |

OMe 2'-O-Methyl
F 2'Flouro
s phosphorothioate linkage
N Mismatches in scrambled controls

TABLE 6

Oligonucleotides with phosphorothioate, 2'-O-methyl, and 2'-fluoro modifications and in vitro efficacy against VEGF.

| Parent AL-DP-# and ORF | AL-DP-# | AL-SQ # | Duplex Sequence and Modifications | SEQ ID NOs | in vitro Efficacy | Mass |
|---|---|---|---|---|---|---|
| 4103 ORF 52 | | 4034 | CCACCAUGCCAAGUGGUCCdTdT | 685 | ++ | |
| | | 4132 | dTdTGGUGGUACGGUUCACCAGG | 686 | | |
| | 4222 | 2510 | CsC$_{OMe}$sAC$_{OMe}$CA$_{OMe}$UG$_{OMe}$CC$_{OMe}$AA$_{OMe}$GU$_{OMe}$GG$_{OMe}$UC$_{OMe}$sCsdTsdT | 687 | − | 6810.3 |
| | | 2511 | dTsdTsG$_{OMe}$sG$_{OMe}$UG$_{OMe}$GU$_{OMe}$AC$_{OMe}$GG$_{OMe}$UU$_{OMe}$CA$_{OMe}$CC$_{OMe}$AsG$_{OMe}$sG | 688 | | 6947.4 |
| | 4223 | 2540 | C$_{OMe}$sCsA$_{OMe}$CC$_{OMe}$AU$_{OMe}$GC$_{OMe}$CA$_{OMe}$AG$_{OMe}$UG$_{OMe}$GU$_{OMe}$CsC$_{OMe}$sdTsdT | 689 | − | 6824.3 |
| | | 2541 | dTsdTsG$_{OMe}$sGU$_{OMe}$GG$_{OMe}$UA$_{OMe}$CG$_{OMe}$GU$_{OMe}$UC$_{OMe}$AC$_{OMe}$CA$_{OMe}$sGsG$_{OMe}$ | 690 | | 6961.4 |
| | 4224 | 2510 | CsC$_{OMe}$sAC$_{OMe}$CA$_{OMe}$UG$_{OMe}$CC$_{OMe}$AA$_{OMe}$GU$_{OMe}$GG$_{OMe}$UC$_{OMe}$sCsdTsdT | 687 | +/− | 6810.3 |
| | | 2541 | dTsdTsG$_{OMe}$sGU$_{OMe}$GG$_{OMe}$UAcJMeCG$_{OMe}$GU$_{OMe}$UC$_{OMe}$AC$_{OMe}$CA$_{OMe}$sGsG$_{OMe}$ | 690 | 6961.4 | |
| | 4225 | 2540 | C$_{OMe}$sCsA$_{OMe}$CC$_{OMe}$AU$_{OMe}$GC$_{OMe}$CA$_{OMe}$AG$_{OMe}$UG$_{OMe}$GU$_{OMe}$CsC$_{OMe}$sdTsdT | 689 | − | 6824.3 |
| | | 2511 | dTsdTsG$_{OMe}$sG$_{OMe}$UG$_{OMe}$GU$_{OMe}$AC$_{OMe}$GG$_{OMe}$UU$_{OMe}$CA$_{OMe}$CC$_{OMe}$AsG$_{OMe}$sG | 688 | | 6947.4 |
| | 4226 | 2570 | C$_{OMe}$sC$_{OMe}$AC$_{OMe}$AC$_{OMe}$C$_{OMe}$AU$_{OMe}$GC$_{OMe}$C$_{OMe}$AAGU$_{OMe}$GG$_{OMe}$U$_{OMe}$C$_{OMe}$AC$_{OMe}$C$_{OMe}$C$_{OMe}$dTsdT | 691 | − | 6790.4 |
| | | 2571 | dTsdTGGU$_{OMe}$GGU$_{OMe}$AC$_{OMe}$GGU$_{OMe}$U$_{OMe}$C$_{OMe}$AC$_{OMe}$C$_{OMe}$AGsG | 692 | | 6885.4 |
| | 4227 | 2600 | CsC$_{OMe}$ACC$_{OMe}$AU$_{OMe}$GCC$_{OMe}$AAGU$_{OMe}$GGUCCdTsdT | 693 | − | 6706.2 |
| | | 2601 | dT5TGGU$_{OMe}$GGU$_{OMe}$AC$_{OMe}$GGU$_{OMe}$UCAC$_{OMe}$CAG5G | 694 | | 6843.3 |
| | 4228 | 2570 | C$_{OMe}$sC$_{OMe}$AC$_{OMe}$AC$_{OMe}$C$_{OMe}$AU$_{OMe}$GC$_{OMe}$C$_{OMe}$AAGU$_{OMe}$GG$_{OMe}$U$_{OMe}$C$_{OMe}$AC$_{OMe}$C$_{OMe}$C$_{OMe}$dT5dT | 691 | − | 6790.4 |
| | | 2631 | dTsdTGGU$_F$GGU$_F$AC$_F$GGU$_F$U$_F$C$_F$AC$_F$C$_F$AGsG | 695 | | 6789.1 |
| | 4229 | 2600 | CsC$_{OMe}$ACC$_{OMe}$AU$_{OMe}$GCC$_{OMe}$MGU$_{OMe}$GGUCCdTsdT | 693 | + | 6706.2 |
| | | 2661 | dTsdTGGU$_F$GGU$_F$AC$_F$GGU$_F$UCAC$_F$CAGsG | 696 | | 6783.1 |
| 4088 ORF 60 | | 4042 | CCAAGUGGUCCCAGGCUGCdTdT | 697 | +++ | |
| | | 4140 | dTdTGGUUCACCAGGGUCCGACG | 698 | | |
| | 4230 | 2512 | CsC$_{OMe}$sAA$_{OMe}$GU$_{OMe}$GG$_{OMe}$UC$_{OMe}$CC$_{OMe}$AG$_{OMe}$GC$_{OMe}$UG$_{OMe}$sCsdTsdT | 699 | − | 6566.3 |
| | | 2513 | dTsdTsGsG$_{OMe}$UU$_{OMe}$CA$_{OMe}$CC$_{OMe}$AG$_{OMe}$GG$_{OMe}$UC$_{OMe}$CG$_{OMe}$AsC$_{OMe}$sG | 700 | | 6906.4 |

TABLE 6-continued

Oligonucleotides with phosphorothioate, 2'-O-methyl, and
2'-fluoro modifications and in vitro efficacy against VEGF.

| Parent AL-DP-# and ORF | AL-DP-# | AL-SQ # | Duplex Sequence and Modifications | SEQ ID NOs | in vitro Efficacy | Mass |
|---|---|---|---|---|---|---|
| | | 4231 2542 | $C_{OMe}sCsA_{OMe}AG_{OMe}UG_{OMe}GU_{OMe}CC_{OMe}CA_{OMe}GG_{OMe}CU_{OMe}GsC_{OMe}sdTsdT$ | 701 | – | 6880.4 |
| | | 2543 | $dTsdTsG_{OMe}sGU_{OMe}UC_{OMe}AC_{OMe}CA_{OMe}GG_{OMe}GU_{OMe}CC_{OMe}GA_{OMe}sCsG_{OMe}$ | 702 | | 6920.4 |
| | | 4232 2512 | $CsC_{OMe}sAA_{OMe}GU_{OMe}GG_{OMe}UC_{OMe}CC_{OMe}AG_{OMe}GC_{OMe}UG_{OMe}sCsdTsdT$ | 699 | – | 6866.3 |
| | | 2543 | $dTsdTsG_{OMe}sGU_{OMe}UC_{OMe}AC_{OMe}CA_{OMe}GG_{OMe}GU_{OMe}CC_{OMe}GA_{OMe}sCsG_{OMe}$ | 702 | | 6920.4 |
| | | 4233 2542 | $C_{OMe}sCsA_{OMe}AG_{OMe}UG_{OMe}GU_{OMe}CC_{OMe}CA_{OMe}GG_{OMe}CU_{OMe}GsC_{OMe}sdTsdT$ | 701 | – | 6880.4 |
| | | 2513 | $dTsdTsGsG_{OMe}UU_{OMe}CA_{OMe}CC_{OMe}AG_{OMe}GG_{OMe}UC_{OMe}CG_{OMe}AsC_{OMe}sG$ | 700 | | 6906.4 |
| | | 4234 2572 | $C_{OMe}sC_{OMe}AAGU_{OMe}GGU_{OMe}C_{OMe}C_{OMe}C_{OMe}AGGC_{OMe}U_{OMe}GC_{OMe}dTsdT$ | 703 | – | 6832.4 |
| | | 2573 | $dTsdTGGU_{OMe}U_{OMe}C_{OMe}AC_{OMe}C_{OMe}AGGGU_{OMe}C_{OMe}C_{OMe}GAC_{OMe}sG$ | 704 | | 6858.4 |
| | | 4235 2602 | $CsC_{OMe}AAGU_{OMe}GGUCCC_{OMe}AGGCU_{OMe}GCdTsdT$ | 705 | + | 6748.2 |
| | | 2603 | $dTsdTGGUUCAC_{OMe}CAGGGU_{OMe}CCGAC_{OMe}sG$ | 706 | | 6788.2 |
| | | 4236 2572 | $C_{OMe}sC_{OMe}AAGU_{OMe}GGU_{OMe}C_{OMe}C_{OMe}C_{OMe}AGGC_{OMe}U_{OMe}GC_{OMe}dTsdT$ | 703 | +++ | 6832.4 |
| | | 2633 | $dTsdTGGU_FU_FC_FAC_FC_FAGGGU_FC_FC_FGAC_{OMe}sG$ | 707 6750.1 | | |
| | | 4237 2602 | $CsC_{OMe}AAGU_{OMe}GGUCCC_{OMe}AGGCU_{OMe}GCdTsdT$ | 705 | +++ | 6748.2 |
| | | 2663 | $dTsdTGGU_FUCAC_FCAGGGU_FCCGAC_FsG$ | 708 | | 6740.1 |
| 4055 ORF 61 | 4043 | | $CAAGUGGUCCCAGGCUGCAdTdT$ | 709 | +++ | |
| | 4141 | | $dTdTGUUCACCAGGGUCCGACGU$ | 710 | | |
| | | 4358 2736 | $CA_{OMe}AG_{OMe}UG_{OMe}GU_{OMe}CC_{OMe}CA_{OMe}GG_{OMe}CU_{OMe}GC_{OMe}AdTsdT$ | 711 | – | |
| | | 2744 | $dTsdTGU_{OMe}UC_{OMe}AC_{OMe}CA_{OMe}GG_{OMe}GU_{OMe}CC_{OMe}GA_{OMe}CG_{OMe}U$ | 712 | | |
| | | 4359 2737 | $C_{OMe}AA_{OMe}GU_{OMe}GG_{OMe}UC_{OMe}CC_{OMe}AG_{OMe}GC_{OMe}UG_{OMe}CA_{OMe}dTsdT$ | 713 | – | |
| | | 2745 | $dTsdTG_{OMe}UU_{OMe}CA_{OMe}CC_{OMe}AG_{OMe}GG_{OMe}UC_{OMe}CG_{OMe}AC_{OMe}GU_{OMe}$ | 714 | | |
| | | 4360 2736 | $CA_{OMe}AG_{OMe}UG_{OMe}GU_{OMe}CC_{OMe}CA_{OMe}GG_{OMe}CU_{OMe}GC_{OMe}AdTsdT$ | 711 | – | |
| | | 2745 | $dTsdTG_{OMe}UU_{OMe}CA_{OMe}CC_{OMe}AG_{OMe}GG_{OMe}UC_{OMe}CG_{OMe}AC_{OMe}GU_{OMe}$ | 714 | | |
| | | 4361 2737 | $C_{OMe}AA_{OMe}GU_{OMe}GG_{OMe}UC_{OMe}CC_{OMe}AG_{OMe}GC_{OMe}UG_{OMe}CA_{OMe}dTsdT$ | 713 | – | |
| | | 2744 | $dTsdTGU_{OMe}UC_{OMe}AC_{OMe}CA_{OMe}GG_{OMe}GU_{OMe}CC_{OMe}GA_{OMe}CG_{OMe}U$ | 712 | | |
| | | 4362 2735 | $C_{OMe}AAGU_{OMe}GGU_{OMe}C_{OMe}C_{OMe}C_{OMe}AGGC_{OMe}U_{OMe}GC_{OMe}AdTsdT$ | 715 | – | |
| | | 2743 | $dTsdTGU_{OMe}U_{OMe}C_{OMe}AC_{OMe}C_{OMe}AGGGU_{OMe}C_{OMe}C_{OMe}GAC_{OMe}GU_{OMe}$ 716 | | | |
| | | 4363 2734 | $C_{OMe}AAGU_{OMe}GGUCCC_{OMe}AGGCU_{OMe}GC_{OMe}AdTsdT$ | 717 | – | |
| | | 2742 | $dTsdTGU_{OMe}UCAC_{OMe}CAGGGU_{OMe}CCGAC_{OMe}GU_{OMe}$ | 718 | | |
| | | 4364 2735 | $C_{OMe}AAGU_{OMe}GGU_{OMe}C_{OMe}C_{OMe}C_{OMe}AGGC_{OMe}U_{OMe}GC_{OMe}AdTsdT$ | 715 | –? | |
| | | 2747 | $dTsdTGU_FU_FC_FAC_FC_FAGGGU_FC_FC_FGAC_FGU_F$ | 719 | | |
| | | 4365 2734 | $C_{OMe}AAGU_{OMe}GGUCCCOMeAGGCU_{OMe}GC_{OMe}AdTsdT$ | 717 | +++ | |
| | | 2746 | $dTsdTGU_FUCAC_FCAGGGU_FCCGAC_FGU_F$ | 720 | | |
| 4019 ORF 102 | 4003 | | $AGAAUCAUCACGAAGUGGUdTdT$ | 721 | ++ | |
| | 4070 | | $dTdTUCUUAGUAGUGCUUCACCA$ | 722 | | |
| | | 4238 2514 | $AsG_{OMe}sAA_{OMe}UC_{OMe}AUCAO\sim OCG_{OMe}AA_{OMe}GU_{OMe}GG_{OMe}sUsdTsdT$ | 723 | – | 6923.4 |
| | | 2515 | $dTsdTsUsC_{OMe}UU_{OMe}AG_{OMe}UA_{OMe}GU_{OMe}GC_{OMe}UU_{OMe}CA_{OMe}CsC_{OMe}sA$ | 724 | | 6774.2 |
| | | 4239 2544 | $A_{OMe}sGsA_{OMe}AU_{OMe}CAOMeUC_{OMe}AC_{OMe}GA_{OMe}AG_{OMe}UG_{OMe}GsU_{OMe}sdTsdT$ | 725 | – | 6937.4 |
| | | 2545 | $dTsdTsU_{OMe}sCU_{OMe}UA_{OMe}GU_{OMe}AG_{OMe}UG_{OMe}CU_{OMe}UC_{OMe}AC_{OMe}sCsA_{OMe}$ | 726 | | 6788.3 |
| | | 4240 2514 | $AsG_{OMe}sAA_{OMe}UC_{OMe}AUCA_{OMe}CG_{OMe}AA_{OMe}GU_{OMe}GG_{OMe}sUsdTsdT$ | 723 | – | 6923.4 |
| | | 2545 | $dTsdTsU_{OMe}sCU_{OMe}UA_{OMe}GU_{OMe}AG_{OMe}UG_{OMe}CU_{OMe}UC_{OMe}AC_{OMe}sCsA_{OMe}$ | 726 | | 6788.3 |
| | | 4241 2544 | $A_{OMe}sGsA_{OMe}AU_{OMe}CA_{OMe}UC_{OMe}AC_{OMe}GA_{OMe}AG_{OMe}UG_{OMe}GsU_{OMe}sdTsdT$ | 725 | – | 6937.4 |
| | | 2515 | $dTsdTsUsC_{OMe}UU_{OMe}AG_{OMe}UA_{OMe}GU_{OMe}GC_{OMe}UU_{OMe}CA_{OMe}CsC_{OMe}sA$ | 724 | | 6774.2 |
| | | 4242 2574 | $A_{OMe}sGAAU_{OMe}C_{OMe}AU_{OMe}C_{OMe}AC_{OMe}GAAGU_{OMe}GGU_{OMe}dTsdT$ | 727 | – | 6847.4 |
| | | 2575 | $dTsdTU_{OMe}C_{OMe}U_{OMe}U_{OMe}AGU_{OMe}AGU_{OMe}GU_{OMe}U_{OMe}C_{OMe}AC_{OMe}C_{OMe}sA$ | 728 | | 6768.3 |
| | | 4243 2604 | $AsGAAUC_{OMe}AU_{OMe}C_{OMe}ACGAAGU_{OMe}GGUdTsdT$ | 729 | – | 6791.2 |
| | | 2605 | $dTsdTUCUUAGU_{OMe}AGU_{OMe}GCUUCAC_{OMe}CsA$ | 730 | | 6642.1 |
| | | 4244 2574 | $A_{OMe}sGAAU_{OMe}C_{OMe}AU_{OMe}C_{OMe}AC_{OMe}GAAGU_{OMe}GGU_{OMe}dTsdT$ | 727 | + | 6847.4 |
| | | 2635 | $dTsdTU_FC_FU_FU_FAGU_FAGU_FGC_{OMe}U_FU_FC_FAC_FC_FsA$ | 731 | | 6624.0 |
| | | 4245 2604 | $AsGAAUC_{OMe}AU_{OMe}C_{OMe}ACGAAGU_{OMe}GGUdTsdT$ | 729 | ++ | 6791.2 |
| | | 2665 | $dTsdTUCUUAGU_FAGU_FGCUUCAC_FCsA$ | 732 | | 6606.0 |
| 4111 ORF 129 | 4007 | | $UGGAUGUCUAUCAGCGCAGdTdT$ | 733 | +++ | |
| | 4074 | | $dTdTACCUACAGAUAGCGCGUC$ | 734 | | |
| | | 4246 2516 | $UsG_{OMe}sGA_{OMe}UG_{OMe}UC_{OMe}UA_{OMe}UC_{OMe}AG_{OMe}CG_{OMe}CA_{OMe}sGsdTsdT$ | 735 | – | 6892.3 |
| | | 2517 | $dTsdTsAsC_{OMe}CU_{OMe}AC_{OMe}AG_{OMe}AU_{OMe}AG_{OMe}UC_{OMe}GC_{OMe}GsU_{OMe}sC$ | 736 | | 6835.3 |
| | | 4247 2546 | $U_{OMe}sGsG_{OMe}AU_{OMe}GU_{OMe}CU_{OMe}AU_{OMe}CA_{OMe}GC_{OMe}GC_{OMe}AsG_{OMe}sdTsdT$ | 737 | – | 6906.4 |
| | | 2547 | $dTsdTsA_{OMe}sCC_{OMe}UA_{OMe}CA_{OMe}GA_{OMe}UA_{OMe}GU_{OMe}CG_{OMe}CG_{OMe}sUsC_{OMe}$ | 738 | | 6849.4 |
| | | 4248 2516 | $UsG_{OMe}sGA_{OMe}UG_{OMe}UC_{OMe}UA_{OMe}UC_{OMe}AG_{OMe}CG_{OMe}CA_{OMe}sGsdTsdT$ | 735 | – | 6892.3 |
| | | 2547 | $dTsdTsA_{OMe}sCC_{OMe}UA_{OMe}CA_{OMe}GA_{OMe}UA_{OMe}GU_{OMe}CG_{OMe}CG_{OMe}sUsC_{OMe}$ | 738 | | 6849.4 |
| | | 4249 2546 | $U_{OMe}sGsG_{OMe}AU_{OMe}GU_{OMe}CU_{OMe}AU_{OMe}CA_{OMe}GC_{OMe}GC_{OMe}AsG_{OMe}sdTsdT$ | 737 | – | 6906.4 |
| | | 2517 | $dTsdTsAsC_{OMe}CU_{OMe}AC_{OMe}AG_{OMe}AU_{OMe}AG_{OMe}UC_{OMe}GC_{OMe}GsU_{OMe}sC$ | 736 | | 6835.3 |
| | | 4250 2576 | $U_{OMe}sGGAU_{OMe}GUC_{OMe}U_{OMe}AU_{OMe}C_{OMe}AGC_{OMe}GC_{OMe}AGdTsdT$ | 739 | – | 6844.3 |
| | | 2577 | $dTsdTAC_{OMe}C_{OMe}U_{OMe}AC_{OMe}AGAU_{OMe}AGU_{OMe}C_{OMe}GC_{OMe}GU_{OMe}sC_{OMe}$ | 740 | | 6801.4 |
| | | 4251 2606 | $UsGGAU_{OMe}GUCU_{OMe}AUC_{OMe}AGCGC_{OMe}AGdTsdT$ | 741 | – | 788.2 |
| | | 2607 | $dTsdTAC_{OMe}CUAC_{OMe}AGAU_{OMe}AGU_{OMe}CGCGU_{OMe}sC$ | 742 | | 6731.2 |
| | | 4252 2576 | $U_{OMe}sGGAU_{OMe}GUC_{OMe}U_{OMe}AU_{OMe}C_{OMe}AGC_{OMe}GC_{OMe}AGdTsdT$ | 739 | + | 6844.3 |
| | | 2637 | $dTsdTAC_FU_FU_FAC_FAGAU_{OMe}AGU_FGC_FGU_FsC_F$ | 743 | | 6681.1 |
| | | 4253 2606 | $UsGGAU_{OMe}GUCU_{OMe}AUC_{OMe}AGCGC_{OMe}AGdTsdT$ | 744 | +++ | 6788.2 |
| | | 2667 | $dTsdTAC_FCUAC_FAGAU_FAGU_FCGCGU_FsC$ | 745 | | 6671.1 |

TABLE 6-continued

Oligonucleotides with phosphorothioate, 2'-O-methyl, and
2'-fluoro modifications and in vitro efficacy against VEGF.

| Parent AL-DP-# and ORF | AL-DP-# | AL-SQ # | Duplex Sequence and Modifications | SEQ ID NOs | in vitro Efficacy | Mass |
|---|---|---|---|---|---|---|
| 4028 ORF 149 | ++ | 4014 | UACUGCCAUCCAAUCGAGAdTdT | 746 | | |
| | | 4081 | dTdTAUGACGGUAGGUUAGCUCU | 747 | | |
| | 4254 | 2518 | UsA$_{OMe}$sCU$_{OMe}$GC$_{OMe}$CA$_{OMe}$UC$_{OMe}$CA$_{OMe}$AU$_{OMe}$CG$_{OMe}$AG$_{OMe}$sAsdTsdT | 748 | No data | 6819.3 |
| | | 2519 | dTsdTsAsU$_{OMe}$GA$_{OMe}$CG$_{OMe}$GU$_{OMe}$AG$_{OMe}$GU$_{OMe}$UA$_{OMe}$GC$_{OMe}$UsC$_{OMe}$sU | 749 | | 6893.3 |
| | 4255 | 2548 | U$_{OMe}$sAsC$_{OMe}$UG$_{OMe}$CC$_{OMe}$AU$_{OMe}$CC$_{OMe}$AA$_{OMe}$UC$_{OMe}$GA$_{OMe}$GsA$_{OMe}$sdTsdT | 750 | No data | 6833.4 |
| | | 2549 | dTsdTsA$_{OMe}$sUG$_{OMe}$AC$_{OMe}$GG$_{OMe}$UA$_{OMe}$GG$_{OMe}$UU$_{OMe}$AG$_{OMe}$CU$_{OMe}$sCsU$_{OMe}$ | 751 | | 6907.4 |
| | 4256 | 2518 | UsA$_{OMe}$sCU$_{OMe}$GC$_{OMe}$CA$_{OMe}$UC$_{OMe}$CA$_{OMe}$AU$_{OMe}$CG$_{OMe}$AG$_{OMe}$sAsdTsdT | 748 | No data | 6819.3 |
| | | 2549 | dTsdTsA$_{OMe}$sUG$_{OMe}$AC$_{OMe}$GG$_{OMe}$UA$_{OMe}$GG$_{OMe}$UU$_{OMe}$AG$_{OMe}$CU$_{OMe}$sCsU$_{OMe}$ | 751 | | 6907.4 |
| | 4257 | 2548 | U$_{OMe}$sAsC$_{OMe}$UG$_{OMe}$CC$_{OMe}$AU$_{OMe}$CC$_{OMe}$AA$_{OMe}$UC$_{OMe}$GA$_{OMe}$GsA$_{OMe}$sdTsdT | 750 | No data | 6833.4 |
| | | 2519 | dTsdTsAsU$_{OMe}$GA$_{OMe}$CG$_{OMe}$GU$_{OMe}$AG$_{OMe}$GU$_{OMe}$UA$_{OMe}$GC$_{OMe}$UsC$_{OMe}$sU | 749 | | 6893.3 |
| | 4258 | 2578 | U$_{OMe}$sAC$_{OMe}$U$_{OMe}$GC$_{OMe}$C$_{OMe}$AU$_{OMe}$C$_{OMe}$C$_{OMe}$AAU$_{OMe}$C$_{OMe}$GAGAdTsdT | 752 | – | 6785.4 |
| | | 2579 | dTsdTAU$_{OMe}$GAC$_{OMe}$GGU$_{OMe}$AGGU$_{OMe}$U$_{OMe}$AGC$_{OMe}$U$_{OMe}$C$_{OMe}$sU$_{OMe}$ | 753 | | 6845.3 |
| | 4259 | 2608 | UsACU$_{OMe}$GCC$_{OMe}$AUCC$_{OMe}$AAUCGAGAdTsdT | 754 | ++ | 6701.2 |
| | | 2609 | dTsdTAU$_{OMe}$GAC$_{OMe}$GGU$_{OMe}$AGGU$_{OMe}$UAGCUCsU | 755 | | 6775.2 |
| | 4260 | 2578 | U$_{OMe}$sAC$_{OMe}$U$_{OMe}$GC$_{OMe}$C$_{OMe}$AU$_{OMe}$C$_{OMe}$C$_{OMe}$AAU$_{OMe}$C$_{OMe}$GAGAdTsdT | 752 | + | 6785.4 |
| | | 2639 | dTsdTAU$_F$GAC$_F$GGU$_F$AGGU$_F$U$_F$AGC$_F$U$_F$C$_F$sU$_F$ | 756 | | 6721.1 |
| | 4261 | 2608 | UsACU$_{OMe}$GCC$_{OMe}$AUCC$_{OMe}$AAUCGAGAdTsdT | 754 | + | 6701.2 |
| | | 2669 | dTsdTAU$_F$GAC$_F$GGU$_F$AGGU$_F$UAGCUCsU | 757 | | 6727.1 |
| 4060 ORF 168 | | 4061 | CCCUGGUGGACAUCUUCCAdTdT | 758 | +++ | |
| | | 4159 | dTdTGGGACCACCUGUAGAAGGU | 759 | | |
| | 4262 | 2520 | CsC$_{OMe}$sCU$_{OMe}$GG$_{OMe}$UG$_{OMe}$GA$_{OMe}$CA$_{OMe}$UC$_{OMe}$UU$_{OMe}$CC$_{OMe}$sAsdTsdT | 760 | – | 6788.3 |
| | | 2521 | dTsdTsGsG$_{OMe}$GA$_{OMe}$CC$_{OMe}$AC$_{OMe}$CU$_{OMe}$GU$_{OMe}$AG$_{OMe}$AA$_{OMe}$GsG$_{OMe}$sU | 761 | | 6954.4 |
| | 4263 | 2550 | C$_{OMe}$sCsC$_{OMe}$UG$_{OMe}$GU$_{OMe}$GG$_{OMe}$AC$_{OMe}$AU$_{OMe}$CU$_{OMe}$UC$_{OMe}$CsA$_{OMe}$sdTsdT | 762 | – | 6802.3 |
| | | 2551 | dTsdTsG$_{OMe}$sGG$_{OMe}$AC$_{OMe}$CA$_{OMe}$CC$_{OMe}$UG$_{OMe}$UA$_{OMe}$GA$_{OMe}$AG$_{OMe}$sGsU$_{OMe}$ | 763 | | 6968.5 |
| | 4264 | 2520 | CsC$_{OMe}$sCU$_{OMe}$GG$_{OMe}$UG$_{OMe}$GA$_{OMe}$CA$_{OMe}$UC$_{OMe}$UU$_{OMe}$CC$_{OMe}$sAsdTsdT | 760 | – | 6788.3 |
| | | 2551 | dTsdTsG$_{OMe}$sGG$_{OMe}$AC$_{OMe}$CA$_{OMe}$CC$_{OMe}$UG$_{OMe}$UA$_{OMe}$GA$_{OMe}$AG$_{OMe}$sGsU$_{OMe}$ | 763 | | 6968.5 |
| | 4265 | 2550 | C$_{OMe}$sCsC$_{OMe}$UG$_{OMe}$GU$_{OMe}$GG$_{OMe}$AC$_{OMe}$AU$_{OMe}$CU$_{OMe}$UC$_{OMe}$CsA$_{OMe}$sdTsdT | 762 | – | 6802.3 |
| | | 2521 | dTsdTsGsG$_{OMe}$GA$_{OMe}$CC$_{OMe}$AC$_{OMe}$CU$_{OMe}$GU$_{OMe}$AG$_{OMe}$AA$_{OMe}$GsG$_{OMe}$sU | 761 | | 6954.4 |
| | 4266 | 2580 | C$_{OMe}$sC$_{OMe}$U$_{OMe}$U$_{OMe}$GGU$_{OMe}$GGAC$_{OMe}$AU$_{OMe}$C$_{OMe}$U$_{OMe}$U$_{OMe}$CC$_{OMe}$AdTsdT | 764 | – | 6782.3 |
| | | 2581 | dTsdTGGGAC$_{OMe}$C$_{OMe}$AC$_{OMe}$C$_{OMe}$U$_{OMe}$GU$_{OMe}$AGAAGGsU$_{OMe}$ | 765 | | 6878.4 |
| | 4267 | 2610 | CsCCU$_{OMe}$GGU$_{OMe}$GGAC$_{OMe}$AUCUUCC$_{OMe}$AdTsdT | 766 | + | 6670.1 |
| | | 2611 | dTsdTGGGAC$_{OMe}$CAC$_{OMe}$CUGU$_{OMe}$AGAAGGsU$_{OMe}$ | 767 | | 6836.3 |
| | 4268 | 2580 | C$_{OMe}$sC$_{OMe}$U$_{OMe}$U$_{OMe}$GGU$_{OMe}$GGAC$_{OMe}$AU$_{OMe}$C$_{OMe}$U$_{OMe}$U$_{OMe}$CC$_{OMe}$AdTsdT | 764 | ++ | 6782.3 |
| | | 2641 | dTsdTGGGAC$_F$C$_F$AC$_F$C$_F$U$_F$GU$_F$AGAAGGsU$_F$ | 768 | | 6778.2 |
| | 4269 | 2610 | CsCCU$_{OMe}$GGU$_{OMe}$GGAC$_{OMe}$AUCUUCC$_{OMe}$AdTsdT | 766 | + | 6670.1 |
| | | 2671 | dTsdTGGGAC$_F$CAC$_F$CUGU$_F$AGAAGGsU$_F$ | 769 | | 6772.2 |
| 4015 ORF 175 | | 4066 | GGACAUCUUCCAGGAGUACdTdT | 770 | +++ | |
| | | 4164 | dTdTCCUGUAGAAGGUCCUCAUG | 771 | | |
| | 4270 | 2522 | GsG$_{OMe}$sAC$_{OMe}$AU$_{OMe}$CU$_{OMe}$UC$_{OMe}$CA$_{OMe}$GG$_{OMe}$AG$_{OMe}$UA$_{OMe}$sCsdTsdT | 772 | – | 6875.4 |
| | | 2523 | dTsdTsCsC$_{OMe}$UG$_{OMe}$UA$_{OMe}$GA$_{OMe}$AG$_{OMe}$GU$_{OMe}$CC$_{OMe}$UC$_{OMe}$AsU$_{OMe}$sG | 773 | | 6852.3 |
| | 4271 | 2552 | G$_{OMe}$sGsA$_{OMe}$CA$_{OMe}$UC$_{OMe}$UU$_{OMe}$CC$_{OMe}$AG$_{OMe}$GA$_{OMe}$GU$_{OMe}$AsC$_{OMe}$sdTsdT | 774 | – | 6889.4 |
| | | 2553 | dTsdTsC$_{OMe}$sCU$_{OMe}$GU$_{OMe}$AG$_{OMe}$AA$_{OMe}$GG$_{OMe}$UC$_{OMe}$CU$_{OMe}$CA$_{OMe}$sUsG$_{OMe}$ | 775 | | 6866.3 |
| | 4272 | 2522 | GsG$_{OMe}$sAC$_{OMe}$AU$_{OMe}$CU$_{OMe}$UC$_{OMe}$CA$_{OMe}$GG$_{OMe}$AG$_{OMe}$UA$_{OMe}$sCsdTsdT | 772 | – | 6875.4 |
| | | 2553 | dTsdTsC$_{OMe}$sCU$_{OMe}$GU$_{OMe}$AG$_{OMe}$AA$_{OMe}$GG$_{OMe}$UC$_{OMe}$CU$_{OMe}$CA$_{OMe}$sUsG$_{OMe}$ | 775 | | 6866.3 |
| | 4273 | 2552 | G$_{OMe}$sGsA$_{OMe}$CA$_{OMe}$UC$_{OMe}$UU$_{OMe}$CC$_{OMe}$AG$_{OMe}$GA$_{OMe}$GU$_{OMe}$AsC$_{OMe}$sdTsdT | 772 | – | 6889.4 |
| | | 2523 | dTsdTsCsC$_{OMe}$UG$_{OMe}$UA$_{OMe}$GA$_{OMe}$AG$_{OMe}$GU$_{OMe}$CC$_{OMe}$UC$_{OMe}$AsU$_{OMe}$sG | 773 | | 6852.3 |
| | 4274 | 2582 | G$_{OMe}$sGAC$_{OMe}$AU$_{OMe}$C$_{OMe}$U$_{OMe}$U$_{OMe}$C$_{OMe}$C$_{OMe}$AGGAGU$_{OMe}$AC$_{OMe}$dTsdT | 776 | – | 6827.4 |
| | | 2583 | dTsdTC$_{OMe}$C$_{OMe}$U$_{OMe}$GU$_{OMe}$AGAAGGU$_{OMe}$C$_{OMe}$C$_{OMe}$U$_{OMe}$C$_{OMe}$AU$_{OMe}$sG | 777 | | 6818.3 |
| | 4275 | 2612 | GsGAC$_{OMe}$AUCUUCC$_{OMe}$AGGAGU$_{OMe}$AC$_{OMe}$dTsdT | 778 | – | 6743.2 |
| | | 2613 | dTsdTCCUGU$_{OMe}$AGAAGGU$_{OMe}$CCUCAU$_{OMe}$sG | 779 | | 6720.1 |
| | 4276 | 2582 | G$_{OMe}$sGAC$_{OMe}$AU$_{OMe}$C$_{OMe}$U$_{OMe}$OMeU$_{OMe}$C$_{OMe}$C$_{OMe}$AGGAGU$_{OMe}$AC$_{OMe}$dTsdT | 776 | – | 6827.4 |
| | | 2643 | dTsdTC$_F$C$_F$U$_F$GU$_F$AGAAGGU$_F$C$_F$C$_F$U$_F$C$_F$AU$_F$sG | 780 | | 6698.0 |
| | 4277 | 2612 | GsGAC$_{OMe}$AUCUUCC$_{OMe}$AGGAGU$_{OMe}$AC$_{OMe}$dTsdT | 778 | +++ | 6743.2 |
| | | 2673 | dTsdTCCUGU$_F$AGAAGGU$_F$CCUCAU$_F$sG | 781 | | 6684.0 |
| 4032 ORF 191 | | 4025 | UACCCUGAUGAGAUCGAGUdTdT | 782 | +++ | |
| | | 4092 | dTdTAUGGGACUACUCUAGCUCA | 783 | | |
| | 4278 | 2524 | UsA$_{OMe}$sCC$_{OMe}$CU$_{OMe}$GA$_{OMe}$UG$_{OMe}$AG$_{OMe}$AU$_{OMe}$CG$_{OMe}$AG$_{OMe}$sUsdTsdT | 784 | + | 6876.3 |
| | | 2525 | dTsdTsAsU$_{OMe}$GG$_{OMe}$GA$_{OMe}$CU$_{OMe}$AC$_{OMe}$UC$_{OMe}$UA$_{OMe}$GC$_{OMe}$UsC$_{OMe}$sA | 785 | | 6836.3 |
| | 4279 | 2554 | U$_{OMe}$sAsC$_{OMe}$CC$_{OMe}$UGOMGAU$_{OMe}$GA$_{OMe}$GA$_{OMe}$UC$_{OMe}$GA$_{OMe}$GsU$_{OMe}$sdTsdT | 786 | + | 6890.4 |
| | | 2555 | dTsdTsA$_{OMe}$sUG$_{OMe}$GG$_{OMe}$AC$_{OMe}$UA$_{OMe}$CU$_{OMe}$CU$_{OMe}$AG$_{OMe}$CU$_{OMe}$sCsA$_{OMe}$ | 787 | | 6850.3 |
| | 4280 | 2524 | UsA$_{OMe}$sCC$_{OMe}$CU$_{OMe}$GA$_{OMe}$UG$_{OMe}$AG$_{OMe}$AU$_{OMe}$CG$_{OMe}$AG$_{OMe}$sUsdTsdT | 784 | ++ | 6876.3 |
| | | 2555 | dTsdTsA$_{OMe}$sUG$_{OMe}$GG$_{OMe}$AC$_{OMe}$UA$_{OMe}$CU$_{OMe}$CU$_{OMe}$AG$_{OMe}$CU$_{OMe}$sCsA$_{OMe}$ | 787 | | 6850.3 |
| | 4281 | 2554 | U$_{OMe}$sAsC$_{OMe}$CC$_{OMe}$UG$_{OMe}$AU$_{OMe}$GA$_{OMe}$GA$_{OMe}$UC$_{OMe}$GA$_{OMe}$GsU$_{OMe}$sdTsdT | 786 | – | 6890.4 |
| | | 2525 | dTsdTsAsU$_{OMe}$GG$_{OMe}$GA$_{OMe}$CU$_{OMe}$AC$_{OMe}$UC$_{OMe}$UA$_{OMe}$GC$_{OMe}$UsC$_{OMe}$sA | 785 | | 6836.3 |
| | 4282 | 2584 | U$_{OMe}$sAC$_{OMe}$C$_{OMe}$C$_{OMe}$U$_{OMe}$GAU$_{OMe}$GAGAU$_{OMe}$C$_{OMe}$GAGU$_{OMe}$dTsdT | 788 | – | 6828.3 |
| | | 2585 | dTsdTAU$_{OMe}$GGGACU$_{OMe}$ACUCU$_{OMe}$AGCUC$_{OMe}$sA | 789 | | 6802.3 |
| | 4283 | 2614 | UsACCCU$_{OMe}$GAU$_{OMe}$GAGAUCGAGUdTsdT | 790 | +++ | 6744.2 |
| | | 2615 | dTsdTAU$_{OMe}$GGGAC$_{OMe}$UAC$_{OMe}$UCUAGCUCsA | 791 | | 6704.1 |

TABLE 6-continued

Oligonucleotides with phosphorothioate, 2'-O-methyl, and
2'-fluoro modifications and in vitro efficacy against VEGF.

| Parent AL-DP-# and ORF | AL-DP- # | AL-SQ # | Duplex Sequence and Modifications | SEQ ID NOs | in vitro Efficacy | Mass |
|---|---|---|---|---|---|---|
| | 4284 | 2584 | U$_{OMe}$sAC$_{OMe}$C$_{OMe}$C$_{OMe}$U$_{OMe}$GAU$_{OMe}$GAGAU$_{OMe}$C$_{OMe}$GAGU$_{OMe}$dTsdT | 788 | +++ | 6828.3 |
| | | 2645 | dTsdTAU$_F$GGGAC$_F$UAC$_F$U$_F$C$_F$U$_F$AGC$_F$U$_F$C$_F$sA | 792 | | 6682.0 |
| | 4285 | 2614 | UsACCCU$_{OMe}$GAU$_{OMe}$GAGAUCGAGUdTsdT | 790 | ++ | 6744.2 |
| | | 2675 | dTsdTAU$_F$GGGAC$_F$UAC$_F$UCUAGCUCsA | 793 | | 6668.0 |
| 4033 ORF 305 | | 4026 | ACCAUGCAGAUUAUGCGGAdTdT | 794 | ++ | |
| | | 4093 | dTdTUGGUACGUCUAAUACGCCU | | | |
| | 4286 | 2526 | AsC$_{OMe}$sCA$_{OMe}$UG$_{OMe}$CA$_{OMe}$GA$_{OMe}$UU$_{OMe}$AU$_{OMe}$GC$_{OMe}$GG$_{OMe}$sAsdTsdT | 796 | ++ | 6899.4 |
| | | 2527 | dTsdTsUsG$_{OMe}$GU$_{OMe}$AC$_{OMe}$GU$_{OMe}$CU$_{OMe}$AA$_{OMe}$UA$_{OMe}$CG$_{OMe}$CsC$_{OMe}$sU | 797 | | 6813.3 |
| | 4287 | 2556 | A$_{OMe}$sCsC$_{OMe}$AU$_{OMe}$GC$_{OMe}$AG$_{OMe}$AU$_{OMe}$UA$_{OMe}$UG$_{OMe}$CG$_{OMe}$GsA$_{OMe}$sdTsdT | 798 | + | 6913.4 |
| | | 2557 | dTsdTsU$_{OMe}$sGG$_{OMe}$UA$_{OMe}$CG$_{OMe}$UC$_{OMe}$UA$_{OMe}$AU$_{OMe}$AC$_{OMe}$GC$_{OMe}$sCsU$_{OMe}$ | 799 | | 6827.3 |
| | 4288 | 2526 | AsC$_{OMe}$sCA$_{OMe}$UG$_{OMe}$CA$_{OMe}$GA$_{OMe}$UU$_{OMe}$AU$_{OMe}$GC$_{OMe}$GG$_{OMe}$sAsdTsdT | 796 | − | 6899.4 |
| | | 2557 | dTsdTsU$_{OMe}$sGG$_{OMe}$UA$_{OMe}$CG$_{OMe}$UC$_{OMe}$UA$_{OMe}$AU$_{OMe}$AC$_{OMe}$GC$_{OMe}$sCsU$_{OMe}$ | 799 | | 6827.3 |
| | 4289 | 2556 | A$_{OMe}$sCsC$_{OMe}$AU$_{OMe}$GC$_{OMe}$AG$_{OMe}$AU$_{OMe}$UA$_{OMe}$UG$_{OMe}$CG$_{OMe}$GsA$_{OMe}$sdTsdT | 798 | − | 6913.4 |
| | | 2527 | dTsdTsUsG$_{OMe}$GU$_{OMe}$AC$_{OMe}$GU$_{OMe}$CU$_{OMe}$AA$_{OMe}$UA$_{OMe}$CG$_{OMe}$CsC$_{OMe}$sU | 797 | | 6813.3 |
| | 4290 | 2586 | A$_{OMe}$sCC$_{OMe}$AU$_{OMe}$GC$_{OMe}$AGAU$_{OMe}$U$_{OMe}$AU$_{OMe}$GC$_{OMe}$GGAdTsdT | 800 | − | 6837.4 |
| | | 2587 | dTsdTU$_{OMe}$GGU$_{OMe}$AC$_{OMe}$GU$_{OMe}$C$_{OMe}$U$_{OMe}$AAU$_{OMe}$AC$_{OMe}$GC$_{OMe}$C$_{OMe}$sU$_{OMe}$ | 801 | | 6793.3 |
| | 4291 | 2616 | AsCC$_{OMe}$AU$_{OMe}$GC$_{OMe}$AGAUU$_{OMe}$AU$_{OMe}$GCGGAdTsdT | 802 | 31 | 6795.3 |
| | | 2617 | dTsdTUGG$_{OMe}$AC$_{OMe}$GU$_{OMe}$CUAAU$_{OMe}$AC$_{OMe}$GCCsU | 803 | | 6709.2 |
| | 4292 | 2586 | A$_{OMe}$sCC$_{OMe}$AU$_{OMe}$GC$_{OMe}$AGAU$_{OMe}$U$_{OMe}$AU$_{OMe}$GC$_{OMe}$GGAdTsdT | 800 | +++ | 6837.4 |
| | | 2647 | dTsdTU$_F$GGU$_F$AC$_F$GU$_F$C$_F$U$_F$AAU$_F$AC$_F$GC$_F$C$_F$sU$_F$ | 804 | | 6645 |
| | 4293 | 2616 | AsCC$_{OMe}$AU$_{OMe}$GC$_{OMe}$AGAUU$_{OMe}$AU$_{OMe}$GCGGAdTsdT | 802 | +++ | 6795.3 |
| | | 2677 | dTsdTUGG$_F$AC$_F$GU$_F$CUAAU$_F$AC$_F$GCCsU | 805 | | 6649.0 |
| 4014 ORF 319 | | 4112 | GCGGAUCAAACCUCACCAAdTdT | 806 | +++ | |
| | | 4180 | dTdTCGCCUAGUUUGGAGUGGUU | 807 | | |
| | 4294 | 2528 | GsC$_{OMe}$sGG$_{OMe}$AU$_{OMe}$CA$_{OMe}$AA$_{OMe}$CC$_{OMe}$UC$_{OMe}$AC$_{OMe}$CA$_{OMe}$sAsdTsdT | 808 | + | 6841.4 |
| | | 2529 | dTsdTsCsG$_{OMe}$CC$_{OMe}$UA$_{OMe}$GU$_{OMe}$UU$_{OMe}$GG$_{OMe}$AG$_{OMe}$UG$_{OMe}$GsU$_{OMe}$sU | 809 | | 6886.3 |
| | 4295 | 2558 | G$_{OMe}$sCsG$_{OMe}$GA$_{OMe}$U$_{OMe}$CA$_{OMe}$AA$_{OMe}$AC$_{OMe}$CU$_{OMe}$CA$_{OMe}$CC$_{OMe}$AsA$_{OMe}$sdTsdT | 810 | − | 6855.4 |
| | | 2559 | dTsdTsC$_{OMe}$sGC$_{OMe}$CU$_{OMe}$AG$_{OMe}$UU$_{OMe}$UG$_{OMe}$GA$_{OMe}$GU$_{OMe}$GG$_{OMe}$sUsU$_{OMe}$ | 811 | | 6900.3 |
| | 4296 | 2528 | GsC$_{OMe}$sGG$_{OMe}$AU$_{OMe}$CA$_{OMe}$AA$_{OMe}$CC$_{OMe}$UC$_{OMe}$AC$_{OMe}$CA$_{OMe}$sAsdTsdT | 808 | − | 6841.4 |
| | | 2559 | dTsdTsC$_{OMe}$sGC$_{OMe}$CU$_{OMe}$AG$_{OMe}$UU$_{OMe}$UG$_{OMe}$GA$_{OMe}$GU$_{OMe}$GG$_{OMe}$sUsU$_{OMe}$ | 811 | | 6900.3 |
| | 4297 | 2558 | G$_{OMe}$sCsG$_{OMe}$GA$_{OMe}$U$_{OMe}$CA$_{OMe}$AA$_{OMe}$AC$_{OMe}$CU$_{OMe}$CA$_{OMe}$CC$_{OMe}$AsA$_{OMe}$sdTsdT | 810 | − | 6855.4 |
| | | 2529 | dTsdTsCsG$_{OMe}$CC$_{OMe}$UA$_{OMe}$GU$_{OMe}$UU$_{OMe}$GG$_{OMe}$AG$_{OMe}$UG$_{OMe}$GsU$_{OMe}$sU | 809 | | 6886.3 |
| | 4298 | 2588 | G$_{OMe}$sC$_{OMe}$GGAU$_{OMe}$C$_{OMe}$AAAC$_{OMe}$C$_{OMe}$U$_{OMe}$C$_{OMe}$AC$_{OMe}$C$_{OMe}$AAdTsdT | 812 | − | 6793.4 |
| | | 2589 | dTsdTC$_{OMe}$GC$_{OMe}$C$_{OMe}$U$_{OMe}$AGU$_{OMe}$U$_{OMe}$U$_{OMe}$GGAGU$_{OMe}$GGU$_{OMe}$sU$_{OMe}$ | 813 | | 6852.3 |
| | 4299 | 2618 | GsCGGAUC$_{OMe}$AAACCUC$_{OMe}$ACC$_{OMe}$AAdTsdT | 814 | − | 6709.2 |
| | | 2619 | dTsdTCGCCUAGU$_{OMe}$UUGGAGU$_{OMe}$GGU$_{OMe}$sU | 815 | | 6754.1 |
| | 4300 | 2588 | G$_{OMe}$sC$_{OMe}$GGAU$_{OMe}$C$_{OMe}$AAAC$_{OMe}$C$_{OMe}$U$_{OMe}$C$_{OMe}$AC$_{OMe}$C$_{OMe}$AAdTsdT | 812 | + | 6793.4 |
| | | 2649 | dTsdTC$_F$GC$_F$C$_F$U$_{OMe}$AGU$_F$U$_F$U$_F$GGAGU$_F$GGU$_F$sU$_F$ | 816 | | 6716.0 |
| | 4301 | 2618 | GsCGGAUC$_{OMe}$AAACCUC$_{OMe}$ACC$_{OMe}$AAdTsdT | 814 | +++ | 6709.2 |
| | | 2679 | dTsdTCGCCUAGU$_F$UUGGAGU$_F$GGU$_F$sU | 817 | | 6718.0 |
| 4123 ORF 330 | | 4362 | ACCUCACCAAGGCCAGCACdTdT | 818 | ++ | |
| | | 4363 | dTdTUGGAGUGGUUCCGGUCGUG | 819 | | |
| | 4302 | 2530 | AsC$_{OMe}$sCU$_{OMe}$CA$_{OMe}$CC$_{OMe}$AA$_{OMe}$GG$_{OMe}$CC$_{OMe}$AG$_{OMe}$CA$_{OMe}$sCsdTsdT | 820 | + | 6816.4 |
| | | 2531 | dTsdTsUsG$_{OMe}$CGA$_{OMe}$GU$_{OMe}$GG$_{OMe}$UU$_{OMe}$CC$_{OMe}$GG$_{OMe}$UC$_{OMe}$GsU$_{OMe}$sG | 821 | | 6941.3 |
| | 4303 | 2560 | A$_{OMe}$sCsC$_{OMe}$UC$_{OMe}$AC$_{OMe}$CA$_{OMe}$AG$_{OMe}$GC$_{OMe}$CA$_{OMe}$GC$_{OMe}$AsC$_{OMe}$sdTsdT | 822 | − | 6830.4 |
| | | 2561 | dTsdTsU$_{OMe}$sGG$_{OMe}$AG$_{OMe}$UG$_{OMe}$GU$_{OMe}$UC$_{OMe}$CG$_{OMe}$GU$_{OMe}$CG$_{OMe}$sUsG$_{OMe}$ | 823 | | 6955.4 |
| | 4304 | 2530 | AsC$_{OMe}$sCU$_{OMe}$CA$_{OMe}$CC$_{OMe}$AA$_{OMe}$GG$_{OMe}$CC$_{OMe}$AG$_{OMe}$CA$_{OMe}$sCsdTsdT | 820 | − | 6816.4 |
| | | 2561 | dTsdTsU$_{OMe}$sGG$_{OMe}$AG$_{OMe}$UG$_{OMe}$GU$_{OMe}$UC$_{OMe}$CG$_{OMe}$GU$_{OMe}$CG$_{OMe}$sUsG$_{OMe}$ | 823 | | 6955.4 |
| | 4305 | 2560 | A$_{OMe}$sCsC$_{OMe}$UC$_{OMe}$AC$_{OMe}$CA$_{OMe}$AG$_{OMe}$GC$_{OMe}$CA$_{OMe}$GC$_{OMe}$AsC$_{OMe}$sdTsdT | 822 | − | 6830.4 |
| | | 2531 | dTsdTsUsG$_{OMe}$GA$_{OMe}$GU$_{OMe}$GG$_{OMe}$UU$_{OMe}$CC$_{OMe}$GG$_{OMe}$UC$_{OMe}$GsU$_{OMe}$sG | 821 | | 6941.3 |
| | 4306 | 2590 | A$_{OMe}$sC$_{OMe}$C$_{OMe}$U$_{OMe}$C$_{OMe}$AC$_{OMe}$C$_{OMe}$AAGGC$_{OMe}$C$_{OMe}$AGC$_{OMe}$AC$_{OMe}$dTsdT | 824 | − | 6782.4 |
| | | 2591 | dTsdTU$_{OMe}$GGAGU$_{OMe}$GGU$_{OMe}$U$_{OMe}$C$_{OMe}$CGGU$_{OMe}$C$_{OMe}$GU$_{OMe}$sG$_{OMe}$ | 825 | | 6893.3 |
| | 4307 | 2620 | AsCCUC$_{OMe}$ACC$_{OMe}$AAGGCC$_{OMe}$AGC$_{OMe}$ACdTsdT | 826 | − | 6698.2 |
| | | 2621 | dTsdTUGGAGU$_{OMe}$GGU$_{OMe}$UCCGGU$_{OMe}$CGU$_{OMe}$sG | 827 | | 6823.2 |
| | 4308 | 2590 | A$_{OMe}$sC$_{OMe}$C$_{OMe}$U$_{OMe}$C$_{OMe}$AC$_{OMe}$C$_{OMe}$AAGGC$_{OMe}$C$_{OMe}$AGC$_{OMe}$AC$_{OMe}$dTsdT | 824 | + | 6782.4 |
| | | 2651 | dTsdTU$_F$GGAGU$_F$GGU$_F$U$_F$C$_F$C$_F$GGU$_F$C$_F$GU$_F$sG$_{OMe}$ | 828 | | 6785.1 |
| | 4309 | 2620 | AsCCUC$_{OMe}$ACC$_{OMe}$AAGGCC$_{OMe}$AGC$_{OMe}$ACdTsdT | 826 | + | 6698.2 |
| | | 2681 | dTsdTUGGAGU$_F$GGU$_F$UCCGGU$_F$CGU$_F$sG | 829 | | 6775 1 |
| 4094so ORF 343 | | 4326 | GCACAUAGGAGAGAUGAGCUU | 608 | +++ | |
| | | 4327 | GUCGUGUAUCCUCUCUACUCGAA | 609 | | |
| | 4310 | 2532 | GsC$_{OMe}$sAC$_{OMe}$AU$_{OMe}$AG$_{OMe}$GA$_{OMe}$GA$_{OMe}$GA$_{OMe}$UG$_{OMe}$AG$_{OMe}$sCsUOMCsU | 832 | − | 7019.5 |
| | | 2533 | GsU$_{OMe}$sCsG$_{OMe}$UG$_{OMe}$UA$_{OMe}$UC$_{OMe}$CU$_{OMe}$CU$_{OMe}$CU$_{OMe}$AC$_{OMe}$UC$_{OMe}$GsA$_{OMe}$sA | 833 | | 7487.6 |
| | 4311 | 2562 | G$_{OMe}$sCsA$_{OMe}$CA$_{OMe}$UA$_{OMe}$GG$_{OMe}$AG$_{OMe}$AG$_{OMe}$AU$_{OMe}$GA$_{OMe}$GC$_{OMe}$sUsU$_{OMe}$ | 834 | − | 7033.5 |
| | | 2563 | C$_{OMe}$sGsU$_{OMe}$sGU$_{OMe}$AU$_{OMe}$CC$_{OMe}$UC$_{OMe}$UC$_{OMe}$UA$_{OMe}$CU$_{OMe}$CG$_{OMe}$sAsA$_{OMe}$ | 835 | | 7501.7 |
| | 4312 | 2532 | GsC$_{OMe}$sAC$_{OMe}$AU$_{OMe}$AG$_{OMe}$GA$_{OMe}$GA$_{OMe}$GA$_{OMe}$UG$_{OMe}$AG$_{OMe}$sCsU$_{OMe}$sU | 832 | − | 7019.5 |
| | | 2563 | C$_{OMe}$sGsU$_{OMe}$sGU$_{OMe}$AU$_{OMe}$CC$_{OMe}$UC$_{OMe}$UC$_{OMe}$UA$_{OMe}$CU$_{OMe}$CG$_{OMe}$sAsA$_{OMe}$ | 835 | | 7501.7 |
| | 4313 | 2562 | G$_{OMe}$sCsA$_{OMe}$CA$_{OMe}$UA$_{OMe}$GG$_{OMe}$AG$_{OMe}$AG$_{OMe}$AU$_{OMe}$GA$_{OMe}$GsC$_{OMe}$sUsU$_{OMe}$ | 834 | − | 7033.5 |
| | | 2533 | GsU$_{OMe}$sCsG$_{OMe}$UG$_{OMe}$UA$_{OMe}$UC$_{OMe}$CU$_{OMe}$CU$_{OMe}$CU$_{OMe}$AC$_{OMe}$UC$_{OMe}$GsA$_{OMe}$sA | 833 | | 7487.6 |

TABLE 6-continued

Oligonucleotides with phosphorothioate, 2'-O-methyl, and
2'-fluoro modifications and in vitro efficacy against VEGF.

| Parent AL-DP-# and ORF | AL-DP- # | AL-SQ # | Duplex Sequence and Modifications | SEQ ID NOs | in vitro Efficacy | Mass |
|---|---|---|---|---|---|---|
| | | 4314 | 2592 GsC$_{OMe}$AC$_{OMe}$AU$_{OMe}$AGGAGAGAU$_{OMe}$GAGC$_{OMe}$U$_{OMe}$sU$_{OMe}$ | 836 | + | 6929.4 |
| | | | 2593 GsU$_{OMe}$C$_{OMe}$GU$_{OMe}$GU$_{OMe}$AU$_{OMe}$C$_{OMe}$C$_{OMe}$U$_{OMe}$C$_{OMe}$U$_{OMe}$C$_{OMe}$U$_{OMe}$AC$_{OMe}$U$_{OMe}$C$_{OMe}$GAsA | 837 | | 7495.8 |
| | | 4315 | 2622 GsC$_{OMe}$AC$_{OMe}$AU$_{OMe}$AGGAGAGAU$_{OMe}$GAGCUsU | 838 | +++ | 6887.3 |
| | | | 2623 GsU$_{OMe}$CGU$_{OMe}$GU$_{OMe}$AU$_{OMe}$CCUCUCUAC$_{OMe}$UCGAsA | 839 | | 7355.5 |
| | | 4316 | 2592 GsC$_{OMe}$AC$_{OMe}$AU$_{OMe}$AGGAGAGAU$_{OMe}$GAGC$_{OMe}$U$_{OMe}$sU$_{OMe}$ | 836 | +++ | 6929.4 |
| | | | 2653 GsU$_F$C$_F$GU$_F$GU$_F$AU$_F$C$_F$C$_F$U$_F$C$_F$U$_F$C$_F$U$_F$AC$_F$U$_F$C$_F$GAsA | 840 | | 7283.3 |
| | | 4317 | 2622 GsC$_{OMe}$AC$_{OMe}$AU$_{OMe}$AGGAGAGAU$_{OMe}$GAGCUsU | 838 | + | 6887.3 |
| | | | 2683 GsU$_F$CGU$_F$GU$_F$AU$_F$CCUCUCUAC$_F$UCGAsA | 841 | | 7291.3 |
| 4107do ORF 343 | 4117 | | GCACAUAGGAGAGAUGAGCdTdT | 842 | +++ | |
| | 4185 | | dTdTCGUGUAUCCUCUCUACUCG | 843 | | |
| | | 4318 | 2534 GsC$_{OMe}$sAC$_{OMe}$AU$_{OMe}$AG$_{OMe}$GA$_{OMe}$GA$_{OMe}$GA$_{OMe}$UG$_{OMe}$AG$_{OMe}$sCsdTsdT | 844 | + | 7001.5 |
| | | | 2535 dTsdTsCsG$_{OMe}$UG$_{OMe}$UA$_{OMe}$UC$_{OMe}$CU$_{OMe}$CU$_{OMe}$CU$_{OMe}$AC$_{OMe}$U$_{OMe}$sC$_{OMe}$sG | 845 | | 6726.2 |
| | | 4319 | 2564 G$_{OMe}$sCsA$_{OMe}$CA$_{OMe}$UA$_{OMe}$GG$_{OMe}$AG$_{OMe}$AG$_{OMe}$AU$_{OMe}$GA$_{OMe}$GsC$_{OMe}$sdTsdT | 845 | – | 7015.5 |
| | | | 2565 dTsdTsC$_{OMe}$sGU$_{OMe}$GU$_{OMe}$AU$_{OMe}$CC$_{OMe}$UC$_{OMe}$UC$_{OMe}$UA$_{OMe}$CU$_{OMe}$sCsG$_{OMe}$ | 847 | | 6740.2 |
| | | 4320 | 2534 GsC$_{OMe}$sAC$_{OMe}$AU$_{OMe}$AG$_{OMe}$GA$_{OMe}$GA$_{OMe}$GA$_{OMe}$UG$_{OMe}$AG$_{OMe}$sCsdTsdT | 844 | – | 7001.5 |
| | | | 2565 dTsdTsC$_{OMe}$sGU$_{OMe}$GU$_{OMe}$AU$_{OMe}$CC$_{OMe}$UC$_{OMe}$UC$_{OMe}$UA$_{OMe}$CU$_{OMe}$sCsG$_{OMe}$ | 847 | | 6740.2 |
| | | 4321 | 2564 G$_{OMe}$sCsA$_{OMe}$CA$_{OMe}$UA$_{OMe}$GG$_{OMe}$AG$_{OMe}$AG$_{OMe}$AU$_{OMe}$GA$_{OMe}$GsC$_{OMe}$sdTsdT | 845 | – | 7015.5 |
| | | | 2535 dTsdTsCsG$_{OMe}$UG$_{OMe}$UA$_{OMe}$UC$_{OMe}$CU$_{OMe}$CU$_{OMe}$CU$_{OMe}$AC$_{OMe}$U$_{OMe}$sC$_{OMe}$sG | 845 | | 6726.2 |
| | | 4322 | 2594 G$_{OMe}$sC$_{OMe}$AC$_{OMe}$AU$_{OMe}$AGGAGAGAU$_{OMe}$GAGC$_{OMe}$dTsdT | 848 | – | 6897.4 |
| | | | 2595 dTsdTC$_{OMe}$GU$_{OMe}$GU$_{OMe}$AU$_{OMe}$C$_{OMe}$C$_{OMe}$U$_{OMe}$C$_{OMe}$U$_{OMe}$C$_{OMe}$U$_{OMe}$AC$_{OMe}$U$_{OMe}$C$_{OMe}$sG | 849 | | 6748.3 |
| | | 4323 | 2624 GsC$_{OMe}$AC$_{OMe}$AU$_{OMe}$AGGAGAGAU$_{OMe}$GAGCdTsdT | 850 | +++ | 6883.3 |
| | | | 2625 dTsdTCGU$_{OMe}$GU$_{OMe}$AU$_{OMe}$CCUCUCUAC$_{OMe}$UCsG | 851 | | 6608.0 |
| | | 4324 | 2594 G$_{OMe}$sC$_{OMe}$AC$_{OMe}$AUOMeAGGAGAGAU$_{OMe}$GAGC$_{OMe}$dTsdT | 848 | +++ | 6897.4 |
| | | | 2655 dTsdTC$_F$GU$_F$GU$_F$AU$_F$C$_F$C$_F$U$_F$C$_F$U$_F$C$_F$U$_F$AC$_F$U$_F$C$_F$sG | 852 | | 6579.9 |
| | | 4325 | 2624 GsC$_{OMe}$AC$_{OMe}$AU$_{OMe}$AGGAGAGAU$_{OMe}$GAGCdTsdT | 850 | +++ | 6883.3 |
| | | | 2685 dTsdTCGU$_F$GU$_F$AU$_F$CCUCUCUAC$_F$UCsG | 853 | | 6559.9 |
| 4061 ORF 346 | 4119 | | CAUAGGAGAGAUGAGCUUCdTdT | 854 | +++ | |
| | 4187 | | dTdTGUAUCCUCUCUACUCGAAG | 855 | | |
| | | 4326 | 2536 CsA$_{OMe}$sUA$_{OMe}$GG$_{OMe}$AG$_{OMe}$AG$_{OMe}$AU$_{OMe}$GA$_{OMe}$GC$_{OMe}$UU$_{OMe}$sCsdTsdT | 856 | + | 6939.4 |
| | | | 2537 dTsdTsGsU$_{OMe}$AU$_{OMe}$CC$_{OMe}$UC$_{OMe}$UC$_{OMe}$UA$_{OMe}$CU$_{OMe}$CG$_{OMe}$AsA$_{OMe}$sG | 857 | | 6773.2 |
| | | 4327 | 2566 C$_{OMe}$sAsU$_{OMe}$AG$_{OMe}$GA$_{OMe}$GA$_{OMe}$GA$_{OMe}$UG$_{OMe}$AG$_{OMe}$CU$_{OMe}$Us C$_{OMe}$sdTsdT | 858 | – | 6953.4 |
| | | | 2567 dTsdTsG$_{OMe}$sUA$_{OMe}$UC$_{OMe}$CU$_{OMe}$CU$_{OMe}$CU$_{OMe}$AC$_{OMe}$UC$_{OMe}$GA$_{OMe}$sAsG$_{OMe}$ | 859 | | 6787.3 |
| | | 4328 | 2536 CsA$_{OMe}$sUA$_{OMe}$GG$_{OMe}$AG$_{OMe}$AG$_{OMe}$AU$_{OMe}$GA$_{OMe}$GC$_{OMe}$UU$_{OMe}$sCsdTsdT | 856 | – | 6939.4 |
| | | | 2567 dTsdTsG$_{OMe}$sUA$_{OMe}$UC$_{OMe}$CU$_{OMe}$CU$_{OMe}$CU$_{OMe}$AC$_{OMe}$UC$_{OMe}$GA$_{OMe}$sAsG$_{OMe}$ | 859 | | 6787.3 |
| | | 4329 | 2566 C$_{OMe}$sAsU$_{OMe}$AG$_{OMe}$GA$_{OMe}$GA$_{OMe}$GA$_{OMe}$UG$_{OMe}$AG$_{OMe}$CU$_{OMe}$Us C$_{OMe}$sdTsdT | 858 | – | 6953.4 |
| | | | 2537 dTsdTsGsU$_{OMe}$AU$_{OMe}$CC$_{OMe}$UC$_{OMe}$UC$_{OMe}$UA$_{OMe}$CU$_{OMe}$CG$_{OMe}$AsA$_{OMe}$sG | 857 | | 6773.2 |
| | | 4330 | 2596 C$_{OMe}$sAU$_{OMe}$AGGAGAGAU$_{OMe}$GAGC$_{OMe}$U$_{OMe}$U$_{OMe}$C$_{OMe}$dTsdT | 860 | – | 6863.4 |
| | | | 2597 dTsdTGU$_{OMe}$AU$_{OMe}$C$_{OMe}$C$_{OMe}$U$_{OMe}$C$_{OMe}$U$_{OMe}$C$_{OMe}$U$_{OMe}$AC$_{OMe}$U$_{OMe}$C$_{OMe}$GAAsG | 861 | | 6767.3 |
| | | 4331 | 2626 CsAU$_{OMe}$AGGAGAGAU$_{OMe}$GAGCUUCdTsdT | 862 | ++ | 6807.2 |
| | | | 2627 dTsdTGU$_{OMe}$AU$_{OMe}$CCUCUCUAC$_{OMe}$UCGAAsG | 863 | | 6641.1 |
| | | 4332 | 2596 C$_{OMe}$sAU$_{OMe}$AGGAGAGAU$_{OMe}$GAGC$_{OMe}$U$_{OMe}$U$_{OMe}$C$_{OMe}$dTsdT | 864 | ++ | 6863.4 |
| | | | 2657 dTsdTGU$_F$AU$_F$C$_F$C$_F$U$_F$C$_F$U$_F$C$_F$U$_F$AC$_F$U$_F$C$_F$GMsG | 865 | 6623.0 | |
| | | 4333 | 2626 CsAU$_{OMe}$GAGGAGAGAU$_{OMe}$GAGCUUCdTsdT | 862 | +++ | 6807.2 |
| | | | 2687 dTsdTGU$_F$AU$_F$CCUCUCUAC$_F$UCGAAsG | 866 | | 66050 |
| 4092 ORF 380 | 4123 | | UGUGAAUGCAGACCAAAGAdTdT | 867 | +++ | |
| | 4191 | | dTdTACACUUACGUCUGGUUUCU | 868 | | |
| | | 4334 | 2538 UsG$_{OMe}$sUG$_{OMe}$AA$_{OMe}$UG$_{OMe}$CA$_{OMe}$GA$_{OMe}$CC$_{OMe}$AA$_{OMe}$AG$_{OMe}$sAsdTsdT | 869 | + | 6946.5 |
| | | | 2539 dTsdTsAsC$_{OMe}$AC$_{OMe}$UU$_{OMe}$AC$_{OMe}$GU$_{OMe}$CU$_{OMe}$GG$_{OMe}$UU$_{OMe}$Us C$_{OMe}$sU | 870 | | 6751.2 |
| | | 4335 | 2568 U$_{OMe}$sGsU$_{OMe}$GA$_{OMe}$AU$_{OMe}$GC$_{OMe}$AG$_{OMe}$AC$_{OMe}$CA$_{OMe}$AA$_{OMe}$GsA$_{OMe}$sdTsdT | 871 | – | 6960.5 |
| | | | 2569 dTsdTsA$_{OMe}$sCA$_{OMe}$CU$_{OMe}$UA$_{OMe}$CG$_{OMe}$UC$_{OMe}$UG$_{OMe}$GU$_{OMe}$UU$_{OMe}$sCsU$_{OMe}$ | 872 | | 6765.2 |
| | | 4336 | 2538 UsG$_{OMe}$sUG$_{OMe}$AA$_{OMe}$UG$_{OMe}$CA$_{OMe}$GA$_{OMe}$CC$_{OMe}$AA$_{OMe}$AG$_{OMe}$sAsdTsdT | 869 | | 6946.5 |
| | | | 2569 dTsdTsA$_{OMe}$sCA$_{OMe}$CU$_{OMe}$UA$_{OMe}$CG$_{OMe}$UC$_{OMe}$UG$_{OMe}$GU$_{OMe}$UU$_{OMe}$sCsU$_{OMe}$ | 872 | | 6765.2 |
| | | 4337 | 2568 U$_{OMe}$sGsU$_{OMe}$GA$_{OMe}$AU$_{OMe}$GC$_{OMe}$AG$_{OMe}$AC$_{OMe}$CA$_{OMe}$AA$_{OMe}$GsA$_{OMe}$sdTsdT | 871 | + | 6960.5 |
| | | | 2539 dTsdTsAsC$_{OMe}$AC$_{OMe}$UU$_{OMe}$AC$_{OMe}$GU$_{OMe}$CU$_{OMe}$GG$_{OMe}$UU$_{OMe}$Us C$_{OMe}$sU | 870 | | 6751.2 |
| | | 4338 | 2598 U$_{OMe}$sGU$_{OMe}$GAAU$_{OMe}$GC$_{OMe}$AGAC$_{OMe}$C$_{OMe}$AAAGAdTsdT | 873 | – | 6856.4 |
| | | | 2599 dTsdTACAC$_{OMe}$U$_{OMe}$U$_{OMe}$AC$_{OMe}$GU$_{OMe}$CU$_{OMe}$GGU$_{OMe}$U$_{OMe}$U$_{OMe}$C$_{OMe}$sU$_{OMe}$ | 874 | | 6759.3 |
| | | 4339 | 2628 UsGU$_{OMe}$GAAU$_{OMe}$GC$_{OMe}$AGACC$_{OMe}$AAAGAdTsdT | 875 | – | 6842.3 |
| | | | 2629 dTsdTAC$_{OMe}$AC$_{OMe}$UUAC$_{OMe}$GU$_{OMe}$CUGGU$_{OMe}$UUCsU | 876 | | 6647.1 |
| | | 4340 | 2598 U$_{OMe}$sGU$_{OMe}$GAAU$_{OMe}$GC$_{OMe}$AGAC$_{OMe}$C$_{OMe}$AAAGAdTsdT | 873 | +++ | 6856.4 |
| | | | 2659 dTsdTAC$_F$AC$_F$U$_F$U$_F$AC$_F$GU$_F$C$_F$U$_F$GGU$_F$U$_F$U$_F$C$_F$sU$_F$ | 877 | | 6586.9 |
| | | 4341 | 2628 UsGU$_{OMe}$GAAU$_{OMe}$GC$_{OMe}$AGACC$_{OMe}$AAAGAdTsdT | 875 | ++ | 6842.3 |
| | | | 2689 dTsdTAC$_F$AC$_F$UUAC$_F$GU$_F$CUGGU$_F$UUCsU | 878 | | 6586.9 |
| 4004 so ORF 381 | 4338 | | GUGAAUGCAGACCAAAGAAAG | 879 | +++ | |
| | 4339 | | UACACUUACGUCUGGUUUCUUUC | 880 | | |
| | | 4366 | 2716 GsU$_{OMe}$GA$_{OMe}$AU$_{OMe}$GC$_{OMe}$AGOMGAC$_{OMe}$C$_{OMe}$A$_{OMe}$AA$_{OMe}$GA$_{OMe}$AA$_{OMe}$sG | 881 | + | |
| | | | 2724 UsA$_{OMe}$CA$_{OMe}$CU$_{OMe}$UA$_{OMe}$CG$_{OMe}$UC$_{OMe}$UG$_{OMe}$GU$_{OMe}$UU$_{OMe}$CU$_{OMe}$UU$_{OMe}$sC | 882 | | |
| | | 4367 | 2717 G$_{OMe}$sUG$_{OMe}$AA$_{OMe}$UG$_{OMe}$CA$_{OMe}$GA$_{OMe}$CC$_{OMe}$AA$_{OMe}$AG$_{OMe}$AA$_{OMe}$AsG$_{OMe}$ | 883 | – | |
| | | | 2725 U$_{OMe}$sAC$_{OMe}$AC$_{OMe}$UU$_{OMe}$AC$_{OMe}$GU$_{OMe}$CU$_{OMe}$GG$_{OMe}$UU$_{OMe}$UC$_{OMe}$UU$_{OMe}$UsC$_{OMe}$ | 884 | | |

TABLE 6-continued

Oligonucleotides with phosphorothioate, 2'-O-methyl, and 2'-fluoro modifications and in vitro efficacy against VEGF.

| Parent AL-DP-# and ORF | AL-DP-# | AL-SQ-# | Duplex Sequence and Modifications | SEQ ID NOs | in vitro Efficacy | Mass |
|---|---|---|---|---|---|---|
| | 4368 | 2716 | GsU$_{OMe}$GA$_{OMe}$AU$_{OMe}$GC$_{OMe}$AG$_{OMe}$AC$_{OMe}$CA$_{OMe}$AA$_{OMe}$GA$_{OMe}$AA$_{OMe}$sG | 881 | + | |
| | | 2725 | U$_{OMe}$sAC$_{OMe}$AC$_{OMe}$UU$_{OMe}$AC$_{OMe}$GU$_{OMe}$CU$_{OMe}$GG$_{OMe}$UU$_{OMe}$UC$_{OMe}$UU$_{OMe}$UsC$_{OMe}$ | 884 | | |
| | 4369 | 2717 | G$_{OMe}$sUG$_{OMe}$AA$_{OMe}$UG$_{OMe}$CA$_{OMe}$GA$_{OMe}$CC$_{OMe}$AA$_{OMe}$AG$_{OMe}$AA$_{OMe}$AsG$_{OMe}$ | 883 | + | |
| | | 2724 | UsA$_{OMe}$CA$_{OMe}$CU$_{OMe}$UA$_{OMe}$CG$_{OMe}$UC$_{OMe}$UG$_{OMe}$GU$_{OMe}$UU$_{OMe}$CU$_{OMe}$UU$_{OMe}$sC | 882 | | |
| | 4370 | 2715 | GsU$_{OMe}$GAAU$_{OMe}$GC$_{OMe}$AGAC$_{OMe}$C$_{OMe}$AAAGAAAsG | 885 | − | |
| | | 2723 | U$_{OMe}$sAC$_{OMe}$AC$_{OMe}$U$_{OMe}$U$_{OMe}$AC$_{OMe}$GU$_{OMe}$C$_{OMe}$U$_{OMe}$GGU$_{OMe}$U$_{OMe}$U$_{OMe}$C$_{OMe}$U$_{OMe}$U$_{OMe}$U$_{OMe}$sC$_{OMe}$ | 886 | | |
| | 4371 | 2714 | GsU$_{OMe}$GAAU$_{OMe}$GC$_{OMe}$AGACC$_{OMe}$AAAGAAAsG | 887 | +++ | |
| | | 2722 | UsACAC$_{OMe}$UUAC$_{OMe}$GU$_{OMe}$CUGGU$_{OMe}$UUCUU UsC | 888 | | |
| | 4372 | 2715 | GsU$_{OMe}$GAAU$_{OMe}$GC$_{OMe}$AGAC$_{OMe}$C$_{OMe}$AAAGAAAsG | 885 | +++ | |
| | | 2727 | U$_F$sAC$_F$AC$_F$U$_F$U$_F$AC$_F$GU$_F$C$_F$U$_F$GGU$_F$U$_F$U$_F$C$_F$U$_F$U$_F$sC$_F$ | 889 | | |
| | 4373 | 2714 | GsU$_{OMe}$GAAU$_{OMe}$GC$_{OMe}$AGACC$_{OMe}$AAAGAAAsG | 887 | ++ | |
| | | 2726 | UsACAC$_F$UUAC$_F$GU$_F$CUGGU$_F$UUCUUUsC | 890 | | |

Duplexes are shown with the sense strand written 5' to 3'. The complementary antisense strand is written below the sense strand in the 3' to 5' direction. Lower case "d" indicates a deoxy nucleotide; all other positions are ribo. Lower case "s" indicates a phosphorothioate linkage. subscript "OMe" indicates a 2'-O-methyl sugar and subscript "F" indicates a 2'-fluoro modified sugar. The extinction coefficient is the value at 260 nm(*10$^{-3}$).

TABLE 7

Oligonucleotides with alternating 2'-O-methyl and 2'-fluoro modifications targeting VEGF (SEQ ID NOs 891-908), respectively.

| Parent AL-DP-# | AL-DP-# | AL-SQ-# | Duplex sequence and Modifications | Efficacy | Observed Mass | OD/mg | Extinction Coefficient |
|---|---|---|---|---|---|---|---|
| 4060 | 4399 | 3082 | C$_{OMe}$sC$_F$C$_{OMe}$U$_F$G$_{OMe}$G$_F$U$_{OMe}$G$_F$G$_{OMe}$A$_F$C$_{OMe}$A$_F$U$_{OMe}$C$_F$U$_{OMe}$OU$_F$C$_{OMe}$C$_F$sA$_{OMe}$ | − | 6151.47 | 27.5 | 169 |
| | | 3091 | G$_F$sG$_{OMe}$G$_F$A$_{OMe}$C$_F$C$_{OMe}$A$_F$C$_{OMe}$C$_F$U$_{OMe}$G$_F$U$_{OMe}$A$_F$G$_{OMe}$A$_F$A$_{OMe}$G$_F$G$_{OMe}$sU$_F$ | | | | |
| 4015 | 4400 | 3083 | G$_{OMe}$sG$_F$A$_{OMe}$C$_F$A$_{OMe}$U$_F$C$_{OMe}$U$_F$U$_{OMe}$C$_F$A$_{OMe}$G$_F$A$_{OMe}$G$_F$U$_{OMe}$A$_F$sC$_{OMe}$ | + | 6238.49 | 29 | 186 |
| | | 3092 | C$_F$sC$_{OMe}$U$_F$G$_{OMe}$U$_F$A$_{OMe}$G$_F$A$_{OMe}$A$_F$G$_{OMe}$G$_F$A$_{OMe}$C$_F$C$_{OMe}$U$_F$C$_{OMe}$A$_F$U$_{OMe}$sG$_F$ | | | | |
| 4032 | 4401 | 3084 | U$_{OMe}$sA$_F$C$_{OMe}$C$_F$C$_{OMe}$U$_F$G$_{OMe}$A$_F$U$_{OMe}$G$_F$A$_{OMe}$G$_F$A$_{OMe}$U$_F$C$_{OMe}$G$_F$A$_{OMe}$G$_F$sU$_{OMe}$ | +++ | 6239.47 | 31.8 | 188 |
| | | 3093 | A$_F$sU$_{OMe}$G$_F$G$_{OMe}$G$_F$A$_{OMe}$C$_F$U$_{OMe}$A$_F$C$_{OMe}$U$_F$C$_{OMe}$U$_F$A$_{OMe}$G$_F$U$_{OMe}$C$_F$C$_{OMe}$sA$_F$ | | | | |
| 4033 | 4402 | 3085 | A$_{OMe}$sC$_F$C$_{OMe}$A$_F$U$_{OMe}$G$_F$C$_{OMe}$A$_F$G$_{OMe}$A$_F$U$_{OMe}$A$_F$A$_{OMe}$U$_F$G$_{OMe}$C$_F$G$_{OMe}$G$_F$sA$_{OMe}$ | + | 6262.54 | 30.7 | 194 |
| | | 3094 | U$_F$sG$_{OMe}$G$_F$U$_{OMe}$A$_F$C$_{OMe}$G$_F$U$_{OMe}$C$_F$U$_{OMe}$A$_F$A$_{OMe}$U$_F$A$_{OMe}$C$_F$G$_{OMe}$C$_F$C$_{OMe}$sU$_F$ | | | | |
| 4014 | 4403 | 3086 | G$_{OMe}$sC$_F$G$_{OMe}$G$_F$A$_{OMe}$U$_F$A$_{OMe}$A$_F$A$_{OMe}$C$_F$U$_{OMe}$C$_F$A$_{OMe}$C$_F$C$_{OMe}$A$_F$sA$_{OMe}$ | ++ | 6204.65 | 26.4 | 190 |
| | | 3095 | C$_F$sG$_{OMe}$C$_F$C$_{OMe}$U$_F$A$_{OMe}$U$_F$U$_{OMe}$U$_F$G$_{OMe}$A$_F$G$_{OMe}$U$_F$G$_{OMe}$G$_F$UsU$_F$ | | | | |
| 4094so | 4404 | 3087 | G$_{OMe}$sC$_F$A$_{OMe}$C$_F$A$_{OMe}$U$_F$A$_{OMe}$G$_F$G$_{OMe}$A$_F$A$_{OMe}$G$_F$A$_{OMe}$A$_F$U$_{OMe}$G$_F$A$_{OMe}$G$_F$sC$_{OMe}$ | + | 6364.57 | 31.3 | 206 |
| | | 3096 | C$_F$sG$_{OMe}$U$_F$G$_{OMe}$U$_F$A$_{OMe}$U$_F$C$_{OMe}$C$_F$U$_{OMe}$C$_F$U$_{OMe}$C$_F$U$_{OMe}$A$_F$C$_{OMe}$U$_F$C$_{OMe}$sG$_F$ | | | | |
| 4061 | 4405 | 3088 | C$_{OMe}$sA$_F$U$_{OMe}$A$_F$G$_{OMe}$G$_F$A$_{OMe}$A$_F$G$_{OMe}$A$_F$A$_{OMe}$U$_F$G$_{OMe}$A$_F$G$_{OMe}$C$_F$U$_{OMe}$U$_F$sC$_{OMe}$ | +++ | 6302.59 | 32.8 | 198 |
| | | 3097 | G$_F$sU$_{OMe}$A$_F$U$_{OMe}$C$_F$C$_{OMe}$U$_F$C$_{OMe}$U$_F$U$_{OMe}$C$_F$U$_{OMe}$A$_F$C$_{OMe}$U$_F$C$_{OMe}$G$_F$C$_{OMe}$A$_F$A$_{OMe}$sG$_F$ | | | | |
| 4092 | 4406 | 3089 | U$_{OMe}$sG$_F$U$_{OMe}$G$_F$A$_{OMe}$A$_F$U$_{OMe}$G$_F$A$_{OMe}$A$_F$G$_{OMe}$A$_F$C$_{OMe}$C$_F$A$_{OMe}$A$_F$A$_{OMe}$G$_F$sA$_{OMe}$ | ++ | 6309.63 | 33.6 | 207 |
| | | 3098 | A$_F$sC$_{OMe}$A$_F$C$_{OMe}$U$_F$U$_{OMe}$A$_F$U$_{OMe}$C$_F$U$_{OMe}$G$_F$G$_{OMe}$U$_F$U$_{OMe}$U$_F$C$_{OMe}$sU$_F$ | | | | |
| 4004so | 4407 | 3090 | G$_{OMe}$sU$_F$G$_{OMe}$A$_F$A$_{OMe}$U$_F$G$_{OMe}$C$_F$A$_{OMe}$G$_F$A$_{OMe}$C$_F$C$_{OMe}$A$_F$A$_{OMe}$A$_F$G$_{OMe}$A$_F$sA$_{OMe}$ | +++ | 6332.67 | 30.5 | 213 |
| | | 3099 | C$_F$sA$_{OMe}$C$_F$U$_{OMe}$U$_F$A$_{OMe}$C$_F$G$_{OMe}$U$_F$C$_{OMe}$U$_F$G$_{OMe}$G$_F$U$_{OMe}$U$_F$C$_{OMe}$U$_F$U$_{OMe}$sU$_F$ | | | | |

Duplexes are shown with the sense strand written 5' to 3'. The complementary antisense strand is written below the sense strand in the 3' to 5' direction. Lower case "s" indicates a phosphorothioate linkage. subscript "OMe" indicates a 2'-O-methyl sugar and subscript "F" indicates a 2'-fluoro modified sugar. The parent duplexes had unpaired nucleotides at one or both ends of the duplex. These duplexes have blunt ends. The extinction coefficient is the value at 260 nm (*10$^{-3}$).

TABLE 8A-B

Cholesterol and cholanic acid conjugates of active VEGF sequences
(single strands) (SEQ ID NOs 909-922, respectively).

| Parent AL-DF-# | AL-SQ # | Strand | Sequence and Modifications | Calculated Mass | Found Mass | Purity | OD |
|---|---|---|---|---|---|---|---|
| 4014 | 2363 | sense | GsCsGGAUCAAACCUC$_{OMe}$ACC$_{OMe}$AsAsdTsdTs-Chol | 7466.5 | 7463.8 | 98.2 | |
| 4014 | 2697 | sense | CholsGsCGGAUC$_{OMe}$AA ACCUC$_{OMe}$ACC$_{OMe}$AadTsdT | 7232.3 | 7430.3 | 98.0 | |
| 4014 | 2698 | sense | Chol-sGsCGGAUC$_{OMe}$AAACCUC$_{OMe}$AC$_{OMe}$C$_{OMe}$AAdTsdT | 7446.3 | 7444.3 | 91.0 | |
| 4014 | 2699 | sense | GsCGGAUC$_{OMe}$AAACCUC$_{OMe}$ACC$_{OMe}$AadTs-Chol | 7265.7 | 7265.7 | 98.0 | |
| 4060 | 4940 | sense | Chol-C$_{OMe}$C$_{OMe}$C$_{OMe}$U$_{OMe}$GGU$_{OMe}$GGA-C$_{OMe}$AU$_{OMe}$C$_{OMe}$U$_{OMe}$U$_{OMe}$C$_{OMe}$C$_{OMe}$AdTsdT | | | 100 | 550 |
| 4060 | 2641 | sense | Chol-sC$_{OMe}$C$_{OMe}$C$_{OMe}$U$_{OMe}$GGU$_{OMe}$GGA-C$_{OMe}$AU$_{OMe}$C$_{OMe}$U$_{OMe}$U$_{OMe}$C$_{OMe}$C$_{OMe}$AdTsdT | | | 100 | 583 |
| 4033 | 4935 | sense | Chol-A$_{OMe}$CC$_{OMe}$AU$_{OMe}$GC$_{OMe}$AGAU$_{OMe}$U$_{OMe}$AU$_{OMe}$GC$_{OMe}$GGAdTsdT | | | 100 | 562 |
| 4033 | 4941 | sense | Chol-sA$_{OMe}$CC$_{OMe}$AU$_{OMe}$G-C$_{OMe}$AGAU$_{OMe}$U$_{OMe}$AU$_{OMe}$GC$_{OMe}$GGAdTsdT | | | 100 | 480 |
| 4061 | 4936 | sense | Chol-C$_{OMe}$AU$_{OMe}$AGGAGAGAU$_{OMe}$GAGC$_{OMe}$U$_{OMe}$U$_{OMe}$C$_{OMe}$dTsdT | | | 100 | 532 |
| 4061 | 4942 | sense | Chol-sC$_{OMe}$AU$_{OMe}$AGGAGAGAU$_{OMe}$GAGC$_{OMe}$U$_{OMe}$U$_{OMe}$C$_{OMe}$dTsdT | | | 98.2 | 514 |
| 4094 | 2965 | sense | Chol-GC$_{OMe}$AC$_{OMe}$AU$_{OMe}$AGGAGAGAU$_{OMe}$GAGC$_{OMe}$sU$_{OMe}$ | 7205.7 | 7205.4 | 89.0 | |
| 4014 | 2701 | sense | GsCGGAUC$_{OMe}$AAACCUC$_{OMe}$ACC$_{OMe}$AAdTs-Cholanic | 7219.8 | 7219.4 | 88.2 | |
| 4014 | 2702 | sense | GsCGGAUC$_{OMe}$AAACCUC$_{OMe}$AC$_{OMe}$C$_{OMe}$AAdTs-Cholanic | 7276.3 | 7274.9 | 71.3 | |
| 4014 | 2696 | antisense | Us$^{5Me}$U$_F$GG$^{5Me}$U$_F$GAGGU$^{5Me}$U$_F$$^{5Me}$U$_F$GAUCCGCdTs-Cholanic | | | | |

The strands are shown written 5' to 3'. Lower case "s" indicates a phosphorothioate linkage. The lower case "d" indicates a deoxy residue. Subscript "OMe" indicates a 2'-O-methyl sugar. Subscript "F" indicates a 2'-fluoro. "Chol-" indicates a hydroxyprolinol cholesterol conjugate. "Cholanic" indicates a cholanic acid conjugate. "$^{5Me}$U" indicates a 5-methyl-uridine.

TABLE 8B

| Parent AL-DP-# | AL-DP-# | AL-SQ # | Strand | Sequence and Modifications | SEQ ID NO: | Efficacy | Calculated Mass | Found Mass | Purity |
|---|---|---|---|---|---|---|---|---|---|
| 4014 | 4206 | 2363 2381 | sense as | GsCsGGAUCAAACCUC$_{OMe}$ACC$_{OMe}$AsAsdTsdTs-Chol<br>UsUGGUGAGGUUUGAUCCGCdTsdT | 909 923 | + | 7466.5 | 7463.8 | 98.2 |
| 4014 | 4351 | 2697 4180 | sense as | Chol-sGsCGGAUC$_{OMe}$AA ACCUC$_{OMe}$ACC$_{OMe}$AAdTsdT<br>UUGGUGAGGUUUGAUCCGCTT | 910 924 | − | 7232.3 | 7430.3 | 98.0 |
| 4014 | 4352 | 2698 4180 | sense as | Chol-sGsCGGAUC$_{OMe}$AAACCUC$_{OMe}$AC$_{OMe}$C$_{OMe}$AAdTsdT<br>UUGGUGAGGUUUGAUCCGCTT | 911 924 | − | 7446.3 | 7444.3 | 91.0 |
| 4014 | 4353 | 2699 4180 | sense | GsCGGAUC$_{OMe}$AAACCUC$_{OMe}$ACC$_{OMe}$AAdTs-Chol<br>UUGGUGAGGUUUGAUCCGCU | 912 924 | ++ | 7265.7 | 7265.7 | 98.0 |
| 4094 | 4381 | 2965 2945 | sense AAGfC-as CAfUfC-fUfC-fUfCfCfUAfUGfUGfCfUsG | Chol-GC$_{OMe}$AC$_{OMe}$AU$_{OMe}$AGGAGAGAU$_{OMe}$GAGC$_{OMe}$U$_{OMe}$sU$_{OMe}$ | 925 | ++ | 7205.7 | 7205.4 | 89.0 |
| 4014 | 4209 | 2701 2381 | sense as | GsCGGAUC$_{OMe}$AAACCUC$_{OMe}$ACC$_{OMe}$AAdTs-Cholanic<br>UsUGGUGAGGUUUGAUCCGCdTsdT | 926 927 | ++ | 7219.8 | 7219.4 | 88.2 |
| 4014 | 4210 | 2702 2381 | sense as | GsCGGAUC$_{OMe}$AAACCUC$_{OMe}$AC$_{OMe}$C$_{OMe}$AAdTs-Cholanic<br>UsUGGUGAGGUUUGAUCCGCdTsdT | 928 923 | ++ | 7276.3 | 7274.9 | 71.3 |
| 4014 | 4357 | 4112 2696 | sense anti-sense | GCGGAUCAACCUCACCAATT<br>Us$^{5Me}$U$_F$GG$^{5Me}$UGAGGU$^{5Me}$U$_F$U$_F$GAUCCGCdTs-Cholanic | 929 922 | +++ | | | |
| 4094 | 4390 | 2949 2945 | ss as | Chol-G$_{OMe}$CA$_{OMe}$CA$_{OMe}$UAGGAGAGA$_{OMe}$UGAGC$_{OMe}$UsU<br>AAGfCfUfCAfUfCfUfCfUfCfCfUAfUGfUGfCfUsG | 930 925 | +++ | | | |

TABLE 8B-continued

| Parent AL-DP-# | AL-DP-# | AL-SQ # | | Sequence and Modifications | SEQ ID NO: | Effi-cacy | Calcu-lated Mass | Found Mass | Pur-ity |
|---|---|---|---|---|---|---|---|---|---|
| 4094 | 4391 | 2950 | ss | Gs$_{OMe}$GA$_{OMe}$CA$_{OMe}$UAGGAGAGA$_{OMe}$UGAGC$_{OMe}$UU-Chol | 931 | +++ | | | |
| | | 2945 | as | AAGfCfUfCfAfUfCfUfCfUfCfCfUAfUGfUGfCfUsG | 925 | | | | |
| 4094 | 4392 | 2951 | ss | Thio-Chol-G$_{OMe}$CA$_{OMe}$CA$_{OMe}$UAGGAGAGA$_{OMe}$UGAGC$_{OMe}$UsU | 932 | +++ | | | |
| | | 2945 | as | AAGfCfUfCfAfUfCfUfCfUTCfCfUAfUGfUGfCfUsG | 925 | | | | |
| 4094 | 4393 | 2948 | ss | Chol-G$_{OMe}$CA$_{OMe}$CA$_{OMe}$UAGGAGAGA$_{OMe}$UGAGC$_{OMe}$UU-NH2 | 933 | +++ | | | |
| | | 2945 | as | AAGfCfUfCfAfUfCfUfCfUfCfCfUAfUGfUGfCfUsG | 925 | | | | |
| 4094 | 4394 | 2949 | ss | Chol-G$_{OMe}$CA$_{OMe}$CA$_{OMe}$UAGGAGAGA$_{OMe}$UGAGC$_{OMe}$UsU | 930 | +++ | | | |
| | | 4327 | as | AAGCUCAUCUCUCCUAUGUGCUG | 934 | | | | |
| 4094 | 4395 | 2950 | ss | Gs$_{OMe}$CA$_{OMe}$CA$_{OMe}$UAGGAGAGA$_{OMe}$UGAGC$_{OMe}$UU-Chol | 931 | +++ | | | |
| | | 4327 | as | AAGCUCAUCUCUCCUAUGUGCUG | 934 | | | | |
| 4094 | 4396 | 2951 | ss | Thio-Chol-G$_{OMe}$CA$_{OMe}$CA$_{OMe}$UAGGAGAGA$_{OMe}$UGAGC$_{OMe}$UsU | 932 | +++ | | | |
| | | 4327 | as | AAGCUCAUCUCUCCUAUGUGCUG | 934 | | | | |

The strands are shown written 5' to 3'. Lower case "s" indicates a phosphorothioate linkage. The lower case "d" indicates a deoxy residue. Subscript "OMe" indicates a 2'-O-methyl sugar. Subscript "F" indicates a 2'-fluoro. "Chol-" indicates a hydroxyprolinol cholesterol conjugate. "Cholanic" indicates a cholanic acid conjugate. "$^{5Me}$U" indicates a 5-methyl-uridine.

TABLE 9

Naproxen conjugates of active VEGF secquence.

| Parent AL-DF-# | AL-DF-# | AL-SQ # | Sequence and Modifications | Effi-cacy | Calcu-lated Mass | Found Mass | Purity |
|---|---|---|---|---|---|---|---|
| 4014 | 4355 | 2694 as | Us$^{5Me}$U$_F$GG U$_F$GAGGU$^{5Me}$U$_F$U$_F$GAUCCGCdTsdTs-Naproxen (SEQ ID NO:935) | +++ | 7269.4 | 7270.7 | 80.1 |
| | | 4112 as | GCGGAUCAAACCUCACCAATT (SEQ ID NO:929) | | | | |

The antisense strand of the duplex is shown written 5' to 3'. Lower case "s" indicates a phosphorothioate linkage. Lower case "d" indicates a deoxy. Subscript "F" indicates a 2'-fluor sugar. "$^{5Me}$U" indicates a 5-methyl-uridine. "Naproxen" indicates a naproxen conjugated to the oligonucleotide through a serinol linker.

TABLE 10

Biotin conjugates of active oligonucleotides targeting VEGF.

| Parent AL-DP-# | AL-DP-# | AL-SQ-# | Strand | Sequence and Modifications | Effi-cacy | Calc. Mass | Exp. Mass | Pur-ity |
|---|---|---|---|---|---|---|---|---|
| 4014 | 4356 | 4112 | sense | 5 GCGGAUCAAACCUCACCAATT 3 (SEQ ID NO:929) | +++ | | | |
| | | 2695 | anti-sense | Us$^{5Me}$U$_F$GG$_{OMe}$U$_F$GAGGU$^{5Me}$U$_F$$^{5Me}$U$_F$GAUCCGCdTsdTs-Biotin (SEQ ID NO:936) | | 7285.4 | 7284.3 | 70.2 |
| 4220 | 3071 | | sense | AsAGCUC$_{OMe}$AUCUCUCCU$_{OMe}$AU$_{OMe}$GU$_{OMe}$GC$_{OMe}$U$_{Ome}$sGs-Biotin (SEQ ID NO:937) | Used for ELISA | 7872.1 | 7871.89 | 82.02 |

The oligonucleotides are written 5' to 3'. Lower case "s" indicates a phosphorothioate linkage. Lower case "d" indicates a deoxy. Subscript "OMe" indicates a 2'-O-methyl sugar and subscript "F" indicates a 2'-fluoro modified sugar. "$^{5Me}$U" indicates a 5-methyl uridine.

TABLE 11 a-b.
Conjugation of aldehydes, Retinal and other Retinoids to VEGF siRNAs and model oligonucleotides.

| Sequence ID | Sequence* | Cal Mass | Found Mass | CGE (%) |
|---|---|---|---|---|
| AL-3174 | Q25-dTdTdTdTdTdT dTdTdTdTdTdT | 3767.22 | 3769.09 | A |
| AL-3175 | Q26-dTdTdTdTdTdT dTdTdTdTdTdT | 3980.07 | 3981.37 | A |
| AL-3176 | Q27-dTdTdTdTdTdT dTdTdTdTdTdT | 4034.24 | 4035.56 | A |

TABLE 11-continued

**a-b.
Conjugation of aldehydes, Retinal and other Retinoids to VEGF siRNAs and model oligonucleotides.**

| AL- | Sequence | MW expected | MW observed | | |
|---|---|---|---|---|---|
| AL-4326 | GCACAUAGGAGAGAUGAGCUU (SEQ ID NO:608) | 6799.22 | 6798.88 | A | |
| AL-3177 | Q25-GCACAUAGGAGAGAUGAGCUU (SEQ ID NO:938) | | B | A | |
| AL-3178 | Q27-GCACAUAGGAGAGAUGAGCUU (SEQ ID NO:941) | 7246.66 | 7246.53 | 97%[c] | |
| AL-3166 | GCACAUAGGAGAGAUGAGCUsU (SEQ ID NO:671) | 6815.16 | 6815.10 | A | |
| AL-3184 | Q25-GCACAUAGGAGAGAUGAGCUsU (SEQ ID NO:671) | 6995.16 | B | A | |
| AL-3185 | Q27-GCACAUAGGAGAGAUGAGCUsU (SEQ ID NO:671) | 7261.6 | 7262.47 | 97.8[c] | |
| AL-3193 | Q28-GCACAUAGGAGAGAUGAGCUsU (SEQ ID NO:671) | 7277.61 | E | F | |
| AL-3211 | GAACUGUGUGUGAGAGGUCCsU (SEQ ID NO:940) | 6785.10 | B | A | |
| AL-3212 | Q25-GAACUGUGUGUGAGAGGUCCsU (SEQ ID NO:940) | 6965.10 | G | G | |
| AL-3213 | Q27-GAACUGUGUGUGAGAGGUCCsU (SEQ ID NO:940) | 7231.54 | G | G | |
| AL-3214 | Q26-GAACUGUGUGUGAGAGGUCCsU (SEQ ID NO:940) | 7177.37 | G | G | |

| AL-DP-# | AL-SQ-# | 5'-3' sequence | Comments |
|---|---|---|---|
| AL-DP-4410 | AL3178 | Q27-GCACAUAGGAGAGAUGAGCUU (SEQ ID NO:941) | 5'Retinal 4094 |
| | AL4327 | AAGCUCAUCUCUCCUAUGUGCUG (SEQ ID NO:609) | |
| AL-DP-4413 | AL3185 | Q27-GCACAUAGGAGAGAUGAGCUsU (SEQ ID NO:671) | 5'Retinal, 3'PS 4094 |
| | AL3167 | AAGCUCAUCUCUCCUAUGUGCUsG (SEQ ID NO:942) | |

Q25 = aminooxy-linker
Q26 = 1-pyrene-carboxaldehyde-aminooxy
Q27 = all-trans-retinal-aminooxy
Q28 = 4-keto-retinol
(A) These samples were not purified and thus no CGE analysis.
(B) These samples were not analyzed as they were used in the conjugation reaction in the next step.
(C) There are two isomers (E and Z) and while two peaks were seen in the CGE, only one peak was seen in the LC/MS with one mass only. The CGE % therefore is the areas of the two peaks in the CGE added together.
(D) Only a little bit of the desired product was present in the crude mixture.
(E) Two peaks in the LC/MS were seen with masses of 7276.42 and 7277.72. The masses can be explained by the easy oxidization of retinal to retinal.
(F) The two main products are 33% and 67% by CGE.
(G) To be determined.

TABLE 12

Polyethylene glycol conjugates of active VEGF sequences and control conjugates.

| Parent AL-DP-# | AL-SQ # | Strand[1] | Sequences and Modifications | MW Expected | MW Observed[2] | HPLC retention time | Starting amount | % Yield |
|---|---|---|---|---|---|---|---|---|
| 4094 | 3194 | VEGF sense | GCACAUAGGAGAGAUGACGUUs-HP-NH2 (SEQ ID NO:943) | 7107.46 | 7107.2 | 37.497 | 466.67 mg | 25.9 |
| 4094 | 3195 | VEGF sense | GCACAUAGGAGAGAUGACGUUs-HP-NH2-20KPEG (SEQ ID NO:943) | 27213.19 | 28333.51–29614.44 | 31.283 | 50 mg | 33.8 |

TABLE 12-continued

Polyethylene glycol conjugates of active VEGF sequences and control conjugates.

| Parent AL-DP-# | AL-SQ # | Strand[1] | Sequences and Modifications | MW Expected | MW Observed[2] | HPLC retention time | Starting amount | % Yield |
|---|---|---|---|---|---|---|---|---|
| 5167 | 3164 | control | GsUCAUCACACUGAAUACCAAU-HP-NH2 (SEQ ID NO:944) | 6932.33 | 6932.15 | 19.733 | 491.4 mg | 34.7 |
| 5167 | 3170 | control | GsUCAUCACACUGAAUACCAAU-HP-NH2-5KPEG (SEQ ID NO:944) | 11746.19 | 11000-13000 | 16.822 | 50 mg | 38.4 |
| 5167 | 3171 | control | GsUCAUCACACUGAAUACCAAU-HP-NH2-20KPEG (SEQ ID NO:944) | 26746.19 | 27456-29524 | 16.164 | 50 mg | 39.2 |
| 1000 | 2936 | control | NH2-HP-CUUACGCUGAGUACUUCGAdTsdT (SEQ ID NO:945) | 6915.3 | 6915.01 | 20.506 | | |
| 1000 | 3187 | control | 5KFEG-NH2-HP-CUUACGCUGAGUACUUCGAdTsdT (SEQ ID NO:945) | 12021.46 | 11847-13256 | 17.829 | 50 mg | 39.2 |
| 1000 | 3188 | control | 20KFEG-NH2-HP-CUUACGCUGAGUACUUCGAdTsdT (SEQ ID NO:945) | 27021.46 | 27440-29289 | 16.921 | 50 mg | 33.6 |
| 1000 | 2937 | control | CsUUACGCUGAGUACUUCGAdTdT-HP-NH2 (SEQ ID NO:946) | 6915.3 | 6915.06 | 20.537 | | |
| 1000 | 3172 | control | CsUUACGCUGAGUACUUCGAdTdT-HP-NH2-5KPEG (SEQ ID NO:946) | 12021.46 | 12300-13034 | 17.578 | 50 mg | 48.0 |
| 1000 | 3173 | control | CsUUACGCUGAGUACUUCGAdTdT-HP-NH2-20KFEG (SEQ ID NO:946) | 27021.46 | 27000-29000 | 17.087 | 50 mg | 52.0 |

The strands are shown written 5' to 3'. Lower case "s" indicates a phosphorothioate linkage. The lower case "d" indicates a deoxy residue. "HP-NH2" or "NH2-HP" indicates a hydroxyprolinol amine conjugate used as a control. "HP-NH2-20KFEG" or "20KPEG-NH2-HP" indicates conjugation to polyethylene glycol (20 K) through the hydroxyprolinol linker. "HP-NH2-5KPEG" or sKFEG-NH2-HP" indicates conjugation to polyethylene glycol (20 K) through the hydroxyprolinol linker.
[1]The control in this column indicates that the oligonucleotide is not complementary to VEGF. Oligonucleotides 3164, 3170, and 3171 target ApoB and oligonucleotides 2936, 3187, 3188, 2937, 3172, and 3173 target luciferase.
[2]range in observed molecular weight is due to the polydispersity of PEG starting material.

TABLE 13

Oligonucleotides targeting VEGF with the ribo-difluorotoluyl modification.

| Parent AL-DP-# | AL-DP# | AL-SQ-# | SEQ ID NOs | Duplex Sequence and Modifications | Type | In vitro efficacy | $T_m$ (° C.) |
|---|---|---|---|---|---|---|---|
| 4014 | 4014 | 4112 | 806 | GCGGAUCAAACCUCACCAAdTdT | Control | +++ | 80 |
| | | 4180 | 807 | dTdTCGCCUAGUUUGGAGUGGUU | | | |
| 4014 | | 4112 | 806 | GCGGAUCAAACCUCACCAAdTdT | Mismatch antisense | + | 75 |
| | | 2957 | 947 | dTdTCGCCUAGUUAGGAGUGGUU | | | |
| 4014 | | 4112 | 806 | GCGGAUCAAACCUCACCAAdTdT | Mismatch antisense | + | 75 |
| | | 2958 | 948 | dTdTCGCCUAGUUGGGAGUGGUU | | | |
| 4014 | | 4112 | 806 | GCGGAUCAAACCUCACCAAdTdT | Mismatch antisense | ++ | 75 |
| | | 2959 | 949 | dTdTCGCCUAGUUCGGAGUGGUU | | | |
| 4014 | 4347 | 4112 | 806 | GCGGAUCAAACCUCACCAAdTdT | Difluoro-toluyl | ++ | 76 |
| | | 2472 | 950 | dTdTCGCCUAGUUFGGAGUGGUU | | | |
| 4014 | 4348 | 4112 | 806 | GCGGAUCAAACCUCACCAAdTdT | Difluoro-toluyl | ++ | |
| | | 2473 | 951 | dTdTCGCCUAGUFUGGAGUGGUU | | | |
| 4014 | 4349 | 4112 | 806 | GCGGAUCAAACCUCACCAAdTdT | Difluoro-toluyl | ++ | |
| | | 2474 | 952 | dTdTCGCCUAGFUFGGAGUGGUU | | | |
| 4014 | 4350 | 4112 | 806 | GCGGAUCAAACCUCACCAAdTdT | Difluoro-toluyl | '+ | 70 |
| | | 2475 | 953 | dTdTCGCCUAGFFFGGAGUGGUU | | | |
| 4014 | | 2953 | 954 | GCGGAUCAAGCCCACCAAdTdT | Mismatch sense | | 77 |
| | | 4180 | 807 | dTdTCGCCUAGUUUGGAGUGGUU | | | |

TABLE 13-continued

Oligonucleotides targeting VEGF with the ribo-difluorotoluyl modification.

| Parent AL-DP-# | AL-DP# | AL-SQ-# | SEQ ID NOs | Duplex Sequence and Modifications | Type | In vitro efficacy | $T_m$ (° C.) |
|---|---|---|---|---|---|---|---|
| 4014 | | 2954 | 955 | GCGGAUCAACCCUCACCAAdTdT | Mismatch | | 73 |
| | 4180 | | 807 | dTdTCGCCUAGUUUGGAGUGGUU | sense | | |
| 4014 | | 2955 | 956 | GCGGAUCAAUCCUCACCAAdTdT | Mismatch | | 73 |
| | 4180 | | 807 | dTdTCGCCUAGUUUGGAGUGGUU | sense | | |

Duplexes are shown with the sense strand written 5' to 3'. The complementary antisense strand is written 3' to 5'. Lower case "d" indicates a ribo nucleotide; all other positions are ribo. Lower case "s" indicates a phosphorothioate linkage. "F" indicates a ribo-difluorotoluyl modification. Positions altered relative to the control duplex are indicated in bold face type.

TABLE 14

Oligonucleotides with 2'-arafluoro-2'-deoxy-nucleosides targeting VEGF.

| Parent AL-DP-# | AL-DP-# | AL-SQ-# | Strand | Sequence and Modifications | Efficacy | Expected Mass | Observed Mass | HPLC Purity |
|---|---|---|---|---|---|---|---|---|
| 4014 | 4342 | 2478 | antisense | UT$_{araF}$GGT$_{araF}$GAGGUUT$_{araF}$GAUCCGCdTdT (SEQ ID NO:957) | ++ | 6728.02 | 6727.25 | 92.82 |
| | | 4112 | sense | GCGGAUCAAACCUCACCAATT (SEQ ID NO:923) | | | | |
| 4014 | 4343 | 2479 | antisense | UT$_{araF}$GGT$_{araF}$GAGGUT$_{araF}$T$_{araF}$GAUCCGCdTdT (SEQ ID NO:958) | +++ | 6744.04 | 6743.22 | 91.97 |
| | | 4112 | sense | GCGGAUCAAACCUCACCAATT (SEQ ID NO:923) | | | | |
| 4014 | 4344 | 2480 | antisense | UU$_{araF}$GGU$_{araF}$GAGGUUU$_{araF}$GAUCCGCdTdT (SEQ ID NO:959) | ++ | 6685.94 | 6685.13 | 94.83 |
| | | 4112 | sense | GCGGAUCAAACCUCACCAATT (SEQ ID NO:923) | | | | |
| 4014 | 4345 | 2481 | antisense | UU$_{araF}$GGU$_{araF}$GAGGUU$_{araF}$U$_{araF}$GAUCCGCdTdT (SEQ ID NO:960) | +++ | 6687.93 | 6687.11 | 91.97 |
| | | 4112 | sense | GCGGAUCAAACCUCACCAATT (SEQ ID NO:923) | | | | |
| 4014 | 4346 | 2814 | sense | GCGGAUC$_{araF}$AA ACCUC$_{araF}$AC$_{araF}$C$_{araF}$AAdTdT (SEQ ID NO:961) | +++ | 6699.14 | 6698.42 | 97.60 |
| | | 4180 | antisense | UUGGUGAGGUUUGAUCCGCTT (SEQ ID NO:924) | | | | |

Sequences are shown written 5' to 3'. Lower case "d" indicates a deoxy nucleotide. "U$_{araF}$" indicates a 2'-arafluoro-2'-deoxy-uridine, "T$_{araF}$" indicates a 2'-arafluoro-thymidine, and "C$_{araF}$" indicates a 2'-arafluro-2'-deoxy-cytidine.

TABLE 15

Methylphosphonate-modified VEGF RNAs.

| Parent AL-DP-# | AL-SQ # | Strand | Sequence and Modifications | Calculated Mass | Found Mass | Purity |
|---|---|---|---|---|---|---|
| 4014 | 2501 | sense | GsCsGGAUC$_{mp}$AA ACCUC$_{mp}$A CcmpAsdTsdT (SEQ ID NO:962) | 6712.50 | | |
| 4014 | 2502 | antisense | UsU$_{mp}$sGGUGAGGUU$_{mp}$UGAUCCGsCsdTsdT (SEQ ID NO:963) | 6758.97 | 6766.1 | |
| 4014 | 2503 | antisense | UsU$_{mp}$sGGU$_{mp}$GAGGUU$_{mp}$U$_{mp}$GAUCCGsCsdTsdT (SEQ ID NO:964) | 6756.44 | 6743.99 | |

The oligonucleotides are shown written 5' to 3'. Lower case "s38 indicates a phosphorothioate linkage. Subscript "mp" indicates a methyl phosphonate linkage. Lower case "d" indicates a deoxy nucleotide.

TABLE 16

C-5 Allyamino-modified VEGF RNAs.

| Parent AL-DP-# | AL-SQ # | Strand | Sequence and Modifications | Calculated Mass | Found Mass | Purity |
|---|---|---|---|---|---|---|
| 4014 | 2504 | antisense | UsU$_{aa}$sG GU$_{aa}$GAGGIII$_{aa}$GAUCCGsdTsdT (SEQ ID NO:965) | 6925.38 | 6924.9 | 92.4 |
| 4014 | 2505 | antisense | UsU$_{aa}$sGGU$_{aa}$GAGGUU$_{aa}$U$_{aa}$GAUCCGsCsdTsdT (SEQ ID NO:966) | 6980.40 | 6979.8 | 90.0 |

The oligonucleotides are shown written 5' to 3'. Lower case "s" indicates a phosphorothionte linkage. Subscript "aa" indicates an allyamino modification. Lower case "d" indicates a deoxy nucleotide.

TABLE 17

Miscellaneous Modifications to VEGF RNA (single strands).

| Parent AL-DP-# | AL-SQ # | Strand | SEQ ID NOs | Sequence and Modifications | Calculated Mass | Found Mass | Purity |
|---|---|---|---|---|---|---|---|
| 4107 | 2192 | sense | 967 | GsCACAUAGGAGAGAUGAGCsdTsdT | 6843.36 | 6842.6 | 84.0 |
| 4107 | 2193 | antisense | 968 | GsCUCAUCUCUCC*UAUGUGCsdTsdT | 6584.3 | 6584.1 | 80.0 |
| 4107 | 2194 | sense | 969 | GsCsACAUAGGAGAGAUGAGsCsdTsdT | 6875.0 | 6874.2 | 88.7 |
| 4107 | 2196 | antisense | 970 | GsCACAUsAGGAGAGAUGAGCsdTsdT | 6875.5 | 6874.0 | 88.7 |
| 4014 | 2281 | sense mismatch | 971 | GsCsGGAACAAUCCUGACCAsAsdTsdT | 6755.4 | 6753.9 | 82.9 |
| 4014 | 2282 | antisense mismatch | 972 | UsUsGGUCAGGAUUGUUCCGsCsdTsdT | 6720.0 | 6719.9 | 96.7 |
| 4014 | 2299 | sense mismatch | 973 | GCGGAACAAUCCUGACCAATT | 6675.0 | 6673.8 | 85.9 |
| 4014 | 2300 | antisense mismatch | 974 | UUGGUCAGGAUUGUUCCGCTT | 6639.9 | 6638.5 | 86.5 |
| 4014 | 2200 | sense | 975 | GsCsGGAUCAAACCUCACCAsAsdTsdT | 6715.4 | 6714.3 | 86.0 |
| 4014 | 2201 | antisense | 976 | UsUsGGUGAGGUUUGAUCCGsCsdTsdT | 6760.3 | 6759.6 | 91.2 |
| 4014 | 2202 | sense | 977 | GsCGGAUCAAACCUCACCAAsdTsdT | 6683.2 | 6682.3 | 95.7 |
| 4014 | 2203 | antisense | 978 | UsUGGUGAGGUUUGAUCCGsCsdTsdT | 6728.1 | 6727.3 | 87.6 |
| 4351 | 2206 | sense | 979 | UUCUUUGGUCUGCAU UCAC | 5913.4 | 5912.3 | 98.0 |
| 4359 | 2207 | sense | 980 | UsUGGUGAGGUUUGAUCCGsCsdTsdT | 6760.3 | 6759.05 | 92.0 |
| 4014 | 2210 | sense | 981 | GsCsGGAUCAAACCUCsACCsAsAsdTsdT | 6747.5 | 6746.6 | 82.7 |
| 4014 | 2212 | sense | 982 | GsCsUCAUCUCUCCUsAUGUGCsdTsdT | 6616.3 | 6614.8 | 78.9 |
| 4014 | 2323 | sense | 983 | GsCsGGAUCAAACCUC$_{OMe}$ACC$_{OMe}$AsAsdTsdT | 6743.4 | 6742.3 | 90.0 |
| 4014 | 2324 | sense | 984 | GsCsGGAUCAAACCU$_{OMe}$C$_{OMe}$AC$_{OMe}$C$_{OMe}$AsAsdTsdT | 6771.5 | 6770.4 | 86.8 |
| 4014 | 2325 | sense | 985 | GsCsGGAUCAAACCUC$_{OMe}$5ACC$_{OMe}$sAsAsdTsdT | 6775.5 | 6774.6 | 87.6 |
| 4014 | 2499 | sense | 986 | GCsGGAUC$_{OMe}$AAACCUC$_{OMe}$AC$_{OMe}$C$_{OMe}$AsAsdTsdT | 6771 | 6771.1 | 84.8 |
| 4014 | 2500 | sense | 987 | GsCsGGAUdCAAACCUdCAdCdCAsAsdTsdT | 6651.4 | 6650.6 | 82.6 |
| 4014 | 2506 | antisense | 988 | Us$^{5Me}$U$_F$sGG$^{5Me}$U$_F$GAGGUU$^{5Me}$UGAUCGsCsdTsdT | 6808.4 | 6808 | 82.0 |
| 4014 | 2507 | antisense | 989 | UsU$_F$sGG$^{5Me}$U$_F$GAGGU$^{5Me}$U$_F$$^{5Me}$U$_F$GAUCCGsCsdTsdT | 6824.3 | 6823.3 | 80.2 |
| 4014 | 2508 | antisense | 990 | Us$^{5Me}$U$_F$sGG$^{5Me}$U$_F$GAGGU$_F$U$_F$UGAUCCGsCsdTsdT | 6824.3 | 6823.4 | 84.3 |
| 4014 | 2509 | antisense | 991 | UsU$_{OMe}$sGGU$_{OMe}$GAGGU$^{5Me}$U$_F$U$_F$GAUCCGsCsdTsdT | 6820.3 | 6822.0 | 85.0 |
| 4220 | 2780 | antisense | 992 | GsC$_{OMe}$AC$_{OMe}$AU$_{OMe}$AGGAGAGAU$_{OMe}$GAGCU$_{OMe}$sU | 6901.38 | 6900.77 | 89.29 |

TABLE 17-continued

Miscellaneous Modifications to VEGF RNA (single strands).

| Parent AL-DP-# | AL-SQ # | Strand | SEQ ID NOs | Sequence and Modifications | Calculated Mass | Found Mass | Purity |
|---|---|---|---|---|---|---|---|
| 4060[1] | 2808 | sense | 993 | AsGsCsUsUsAsAsCsCsUsGsUsCsCsUsUsCsAsA | 6230.57 | | |
| 4060[1] | 2809 | antisense | 994 | UsUsGsAsAsGsGsAsCsAsGsGsUsUsAsAsGsCsU | 6413.73 | | |

The oligonucleotides are shown written 5' to 3'. Lower case "s" indicates a phosphorothioate linkage. Lower case "d" indicates a deoxy. Subscript "OMe" indicates a 2'-O-methyl sugar. Subscript "F" indicates a 2'-fluoro. "$^{5Me}$U" indicates a 5-methyl uridine.
[1]The parent duplex has dT overhangs. The phosphorothioate-modified duplex has blunt ends.

TABLE 18

Physical characteristics of VEGF compounds derived from duplexes 4094, 4060, 4033, 4061, 4004, 4014, 4107 and 4003

| Parent duplex | AL-SQ-# | SEQ ID NOs | Sense strands / Antisense strands | | Calc. mass | Obs. mass |
|---|---|---|---|---|---|---|
| AL-DP-4094 | 4326 | 608 | 5'-GCACAUAGGAGAGAUGAGCUU-3' | | 6670.1 | 6670.0 |
| | 4327 | 609 | 3'-GUCGUGUAUCCUCUCUACUCGAA-5' | | 7220.3 | 7220.0 |
| | | Modif Seq | | Modifications | | |
| | 4554 | 997 | 5'-G*CACAUAGGAGAGAUGAGCU*U-3' | 2PS | 6830.3 | 6830.0 |
| | 4557 | 998 | 5'-A*AGCUCAUCUCUCCUAUGUGCU*G-3' | 2PS | 7252.4 | 7252.0 |
| | 4555 | 999 | 5'-G*CACAuAGGAGAGAUGAGCU*U-3' | 2xPS; 1xOMe | 6844.3 | 6844.0 |
| | 4558 | 1000 | 5'-A*AGCUCAUCUCUCCUAUGUGcu*G-3' | 2PS, 2xOMe | 7280.4 | 7280.0 |
| | 4556 | 1001 | 5'-GcAcAuAGGAGAGAuGAGCu*U-3' | 1xPS; 5xOMe | 6884.3 | 6884.0 |
| | 4559 | 1002 | 5'-A*AGCUCAUCUCUCCuAUGUgcu*G-3' | 2xPS, 3xOMe | 7294.4 | 7293.0 |
| | 4563 | 1003 | 5'-G(dC)A(dC)AuAGGAGAGAuGAGCu*U-3' | 1xPS, 3xOMe, 2xdC | 6824.3 | 6824.0 |
| | 4560 | 1004 | 5'-AAGCUcAUCUCUCCuAuGuGCu*G-3' | 1xPS, 5xOMe | 7306.4 | 7306.0 |
| | 4564 | 1005 | 5'-G*CACAU$_{2'F}$AGGAGAGAUGAGCU*U-3' | 2xPS; 1x2'F | 6832.2 | 6831.0 |
| | 4561 | 1006 | 5'-AAGCUcAUCUCUCCuAuGuGcu*G-3' | 1xPS, 6xOMe | 7320.4 | 7320.0 |
| | 4565 | 1007 | 5'-GC2$_F$AC2$_F$AU2$_F$AGGAGAGAU2$_F$GAGCU2$_F$*U-3' | 1xPS; 5x2'F | 6824.3 | 6823.0 |
| | 4562 | 1008 | 5'-AAGCU(dC)AUCUCUCCuAuGuG(dC)u*G-3' | 1xPS, 4xOMe, 2xdC | 7260.4 | 7260.0 |
| | 4566 | 1009 | 5'-GC2$_F$AC2$_F$AuAuAGGAGAGAuGAGCu*U-3' | 1xPS, 3xOMe, 2x2'F | 6860.3 | 6859.0 |
| | 4568 | 1010 | 5'-AAGCUC2$_F$AUCUCUCCU2$_F$AU2$_F$GU2$_F$GCU2$_F$*G-3' | 1xPS, 5x2'F | 7246.4 | 7244.0 |
| | 4567 | 1011 | 5'-GcAcAU2$_F$AGGAGAGAU2$_F$GAGCU*U-3' | 1xPS, 2xOMe, 3x2'F | 6848.3 | 6847.0 |
| | 4569 | 1012 | 5'-AAGCUcAUCUCUCCU2$_F$AU2$_F$GU2$_F$GCU2$_F$*G-3' | 1xPS, 1xOMe, 4x2'F | 7258.4 | tbd |
| | 4567 | 1013 | 5'-GcAcAU2$_F$AGGAGAGAU2$_F$GAGCU2$_F$*U-3' | 1xPS, 2xOMe, 3x2'F | 6848.3 | 6847.0 |
| | 4570 | 1014 | 5'-AAGCUC2$_F$AUCUCUCCuAuGuGCu*G-3' | 1xPS, 4xOMe, 1x2'F | 7294.4 | 7292.0 |
| | 4571 | 1015 | 5'-GcAcAuAgGaGaGaUgAgCu*U-3' | 1xPS, altern. 2'OMe | 6954.3 | 6953.0 |
| | 4572 | 1016 | 5'-aAgCuCaUcUcUcCuAuGuGcU*g-3' | 1xPS, altern. 2'OMe | 7404.4 | 7403.0 |
| | 4352 | 1017 | 5'-GCACAUAGGAGAGAUGAGC-3' | blunt | 6185.8 | 6186.0 |
| | 4353 | 1018 | 5'-GCUCAUCUCUCCUAUGUGC-3' | blunt | 5910.5 | 5910.8 |
| AL-DP-4060 | 4061 | 1019 | 5'-CCCUGGUGGACAUCUUCCATT-3' | | 6581.0 | Tbd |
| | 4159 | 1020 | 3'-TTGGGACCACCUGUAGAAGGU-5' | | 6747.2 | tbd |
| | | Modif Seq | | Modifications | | |
| | 2580 | 1021 | 5'-cccuGGuGGAcAucuuccAT*T | 1xPS, 2'OMe@Py, | 6765.1 | 6764.0 |
| | 2641 | 1022 | 3'-T*TGGGAC2$_F$C2$_F$AC2$_F$C2$_F$U2$_F$GU2$_F$AGAAGGU2$_F$-5' | 1xPS, 2'F@Py | 6777.3 | 6777.9 |
| | 4934 | 1023 | 5'-(Chol)CCCUGGUGGACAUCUUCCAT*T | 1xPS, 2'OMe@Py, 5'Chol | 7470.0 | 7468.0 |
| | 2641 | 1022 | 3'-T*TGGGAC2$_F$C2$_F$AC2$_F$C2$_F$U2$_F$GU2$_F$AGAAGGU2$_F$-5' | 1xPS, 2'F@Py | 6777.3 | 6777.9 |
| | 4940 | 1024 | 5'-(Chol)*CCCUGGUGGACAUCUUCCAT*T | 2xPS, 2'OMe@Py, 5'Chol | 7486.0 | 7485.0 |
| | 2641 | 1022 | 3'-T*TGGGAC2$_F$C2$_F$AC2$_F$C2$_F$U2$_F$GU2$_F$AGAAGGU2$_F$-5' | 1xPS, 2'F@Py | 6777.3 | 6777.9 |
| AL-DP-4033 | 4026 | 1025 | 5'-ACCAUGCAGAUUAUGCGGATT | | 6692.1 | Tbd |
| | 4093 | 1026 | 3'-TTUGGUACGUCUAAUACGCCU-5' | | 6606.0 | tbd |
| | | Modif Seq | | Modifications | | |
| | 2586 | 1027 | 5'-aCcAuGcAGAuuAuGcGGAT*T | 1xPS, 8x 2'OMe | 6820.2 | 6819.0 |
| | 2647 | 1028 | 3'-T*TU2$_F$GGU2$_F$AC2$_F$G U2$_F$C2$_F$U2$_F$AAU2$_F$AC2$_F$GC2$_F$C2$_F$U2$_F$ | 1xPS, 2'F@Py | 6644.0 | 6644.0 |
| | 4935 | 1029 | 5'-(Chol)aCcAuGcAGAuuAuGcGGAT*T | 1xPS, 8x 2'OMe;5'Chol | 7525.1 | |
| | 2647 | 1028 | 3'-T*TU2$_F$GGU2$_F$AC2$_F$AC2$_F$GU2$_F$C2$_F$U2$_F$AAU2$_F$AC2$_F$GC2$_F$C2$_F$U2$_F$ | 1xPS, 2'F@Py | 6644.0 | 6644.0 |
| | 4941 | 1029 | 5'-(Chol)*aCcAuGcAGAuuAuGcGGAT*T | 2xPS, 8x 2'OMe;5'Chol | 7541.1 | 7539.0 |
| | 2647 | 1028 | 3'-T*TU2$_F$GGU2$_F$AC2$_F$AC2$_F$GU2$_F$C2$_F$U2$_F$AAU2$_F$AC2$_F$GC2$_F$C2$_F$U2$_F$ | 1xPS, 2'F@Py | 6644.0 | 6644.0 |
| AL-DP-4061 | 4119 | 1030 | 5'-CAUAGGAGAGAUGAGCUUCTT | | 6732.2 | Tbd |
| | 4187 | 1031 | 3'-TTGUAUCCUCUCUACUCGAAG-5' | | 6566.0 | tbd |

TABLE 18-continued

Physical characteristics of VEGF compounds derived from duplexes 4094, 4060, 4033, 4061, 4004, 4014, 4107 and 4003

| Parent duplex | SEQ ID AL-SQ-# | NOs | Sense strands Antisense strands | Modifications | Calc. mass | Obs. mass |
|---|---|---|---|---|---|---|
| | Modif Seq | | | Modifications | | |
| | 2596 | 1032 | 5'-CAuAGGAGAGAuGAGcuucT*T | 1xPS, 2'OMe @allPy | 6846.3 | 6845.0 |
| | 2657 | 1033 | 3'-TTGuAuccucucuACucGAAG-5'- | 1xPS, 2'F@Py | 6604.1 | 6605.0 |
| | 4936 | 1034 | 5'-(Chol)CAuAGGAGAGAuGAGcuucT*T | 1xPS, 2'OMe @Py 5'Chol | 7551.2 | Tbd |
| | 2657 | 1035 | 3'-TTGuAuccucucuACucGAAG-5' | 1xPS, 2'F@Py | 6604.1 | 6605.0 |
| | 4937 | 1034 | 5'-(Chol)*CAuAGGAGAGAuGAGcuucT*T | 2xPS, 2'OMe@Py, 5'Chol | 7567.2 | 7565.0 |
| | 2657 | 1035 | 3'-TTGuAuccucucuACucGAAG-5' | 1xPS, 2'F@Py | 6604.1 | 6605.0 |
| AL-DP-4331 | 2626 | 1036 | 5'-cAuAGGAGAGAuGAGCUUCT*T-3' | 1xPS, 3x 2'OMe | 6790.3 | 6789.0 |
| | 2627 | 1037 | 3'-T*TGuAuCCUCUCUAcUCGAAG-5' | 1xPS, 3x 2'OMe | 6624.1 | 6624.0 |
| AL-DP-4004 | 4338 | 1038 | 5'-GUGAAUGCAGACCAAAGAAAG-3' | | 6828.3 | tbd |
| | 4339 | 1039 | 3'-UACACUUACGUCUGGUUUCUUUC-5' | | | |
| | Modif Seq | | | Modifications | | |
| | 4350 | 1040 | 5'-GUGAAUGCAGACCAAAGAA-3' | blunt | 6153.8 | 6154.0 |
| | 4351 | 1041 | 5'-UUCUUUGGUCUGCAUUCAC-3' | blunt | 5912.5 | 5911.8 |
| | 4338 | 1038 | 5'-GUGAAUGCAGACCAAAGAAAG-3' | blunt | 6829.3 | |
| | 4344 | 1042 | 5'-CUUUCUUUGGUCUGCAUUCAC-3' | blunt | 6523.9 | 6523.5 |
| AL-DP-4371 | 2714 | 1043 | 5'-GuGAAUGCAGACcAAAGAAA*G-3' | 1xPS, 4x 2'OMe | 6900.4 | 6900.0 |
| | 2722 | 1044 | 3'-U*ACAcUUAcGuCUGGuUUCUUUC-5' | 1xPS, 4x 2'OMe | 7231.3 | 7230.0 |
| AL-DP-4014 | 4112 | 806 | 5'-GCGGAUCAAACCUCACCAATT-3' | | 6634.1 | 6634.5 |
| | 4180 | 807 | 3'-TTCGCCUAGUUUGGAGUGGUU-5' | | 6679.1 | 6680.3 |
| | Modif Seq | | | Modifications | | |
| | 4318 | 1045 | 5'-GCGGAUCAAACCUCACCAAGG-3' | blunt | 6717.2 | tbd |
| | 4342 | 1046 | 5'-CCUUGGUGAGGUUUGAUCCGC-3' | blunt | 6681.0 | 6683.3 |
| | 4346 | 1047 | 5'-GCGGAUCAAACCUCACCAA-3' | blunt | 6025.7 | 6026.5 |
| | 4347 | 1048 | 5'-UUGGUGAGGUUUGAUCCGC-3' | blunt | 6070.6 | 6071.3 |
| AL-DP-4127 | 4358 | 1049 | 5'-G*C*GGAUCAAACCUCACCA*A*T*T-3' | (2+3)PS | 6714.4 | 6714.8 |
| | 2201 | 1050 | 3'-T*T*C*GCCUAGUUUGGAGUGG*U*U-5' | (2+3)PS | 6759.3 | tbd |
| AL-DP-4107 | 4117 | 1051 | 5'-GCACAUAGGAGAGAUGAGCTT-3' | | 6794.2 | 6794.0 |
| | 4185 | 1052 | 3'-TTCGUGUAUCCUCUCUACUCG-5' | | 6518.9 | 6519.0 |
| | Modif Seq | | | Modifications | | |
| | 4326 | 1053 | 5'-GCACAUAGGAGAGAUGAGCUU-3' | | 6799.2 | tbd |
| | 4345 | 1054 | 5'-AAGCUCAUCUCUCCUAUGUGC-3' | blunt | 6569.0 | 6568.5 |
| | 4354 | 1055 | 5'-G*CACAUAGGAGAGAUGAGC*T*T-3' | (1+2)PS | 6842.4 | 6842.5 |
| | 4356 | 1056 | 5'-G*C*ACAUAGGAGAGAUGAG*C*T*T-3' | (2+3)PS | 6874.5 | tbd |
| AL-DP-4003 | 4286 | 1057 | 5'-GGACAUCUUCCAGGAGUACCC-3' | | 6670.1 | 6669.5 |
| | 4287 | 1058 | 5'-GGGUACUCCUGGAAGAUGUCCAC-3' | | 7361.5 | 7362.0 |
| | Modif Seq | | | Modifications | | |
| | 4348 | 1059 | 5'-GGACAUCUUCCAGGAGUAC-3' | Blunt | 6059.7 | 6059.5 |
| | 4349 | 1060 | 5'-GUACUCCUGGAAGAUGUCC-3' | blunt | 6036.7 | 6036.8 |
| | 4286 | 1057 | 5'-GGACAUCUUCCAGGAGUACCC-3' | blunt | 6671.1 | tbd |
| | 4343 | 1061 | 5'-GGGUACUCCUGGAAGAUGUCC-3 | blunt | 6727.1 | 6727.5 |

Abbreviations used:
Lower case letters: 2'OMe ribonucleotides
T: Deoxythymidine
(Chol): Cholesterol
Upper case letters followed by subscript 2'F: 2'F ribonucleotides
(dC): Deoxycytidine
Tbd: to be determined
Upper case letters: regular ribonucleotides
*: Phosphorothioate linkage
Altern.: alternating

OTHER EMBODIMENTS

A number of embodiments of the invention have been described. Nevertheless, it will be understood that various modifications may be made without departing from the spirit and scope of the invention. Accordingly, other embodiments are within the scope of the following claims.

SEQUENCE LISTING (1088 sequences)

SEQ ID NO: 1 - RNA, 444 nt, Homo sapiens
augaacuuucugcugucuugggugcauuggagccuugccuugcugcucuaccuccaccaugccaaguggucccaggcugcacccauggcagaaggaggagggcagaaucaucacgaaguggugaaguucauggaugucuaucagcgcagcuacugccauccaaucgagacccugguggacaucuuccaggaguacccugaugagaucgaguacaucuucaagccauccugugugccccugaugcgaugcgggggcugcugcaaugacgagggccuggagugugugcccacugaggaguccaacaucaccaugcagauuaugcggaucaaaccucaccaaggccagcacauaggagagaugagcuuccuacagcacaacaaaugugaaugcagaccaaagaaagauagagcaagacaagaaaaaugugacaagccgaggcgguga

SEQ ID NO: 2 - RNA, 23 nt, Homo sapiens
augaacuuucugcugucuugggu

SEQ ID NO: 3 - RNA, 23 nt, Homo sapiens
ugaacuuucugcugucuugggug

SEQ ID NO: 4 - RNA, 23 nt, Homo sapiens
gaacuuucugcugucuugggugc

SEQ ID NO: 5 - RNA, 23 nt, Homo sapiens
aacuuucugcugucuugggugca

SEQ ID NO: 6 - RNA, 23 nt, Homo sapiens
acuuucugcugucuugggugcau

SEQ ID NO: 7 - RNA, 23 nt, Homo sapiens
cuuucugcugucuugggugcauu

SEQ ID NO: 8 - RNA, 23 nt, Homo sapiens
uuucugcugucuugggugcauug

SEQ ID NO: 9 - RNA, 23 nt, Homo sapiens
uucugcugucuugggugcauugg

SEQ ID NO: 10 - RNA, 23 nt, Homo sapiens
ucugcugucuugggugcauugga

SEQ ID NO: 11 - RNA, 23 nt, Homo sapiens
cugcugucuugggugcauuggag

SEQ ID NO: 12 - RNA, 23 nt, Homo sapiens
ugcugucuugggugcauuggagc

SEQ ID NO: 13 - RNA, 23 nt, Homo sapiens
gcugucuugggugcauuggagcc

SEQ ID NO: 14 - RNA, 23 nt, Homo sapiens
cugucuugggugcauuggagccu

SEQ ID NO: 15 - RNA, 23 nt, Homo sapiens
ugucuugggugcauuggagccuu

SEQ ID NO: 16 - RNA, 23 nt, Homo sapiens
gucuugggugcauuggagccuug

SEQ ID NO: 17 - RNA, 23 nt, Homo sapiens
ucuugggugcauuggagccuugc

SEQ ID NO: 18 - RNA, 23 nt, Homo sapiens
cuugggugcauuggagccuugcc

SEQ ID NO: 19 - RNA, 23 nt, Homo sapiens
uugggugcauuggagccuugccu

SEQ ID NO: 20 - RNA, 23 nt, Homo sapiens
ugggugcauuggagccuugccuu

SEQ ID NO: 21 - RNA, 23 nt, Homo sapiens
gggugcauuggagccuugccuug

SEQ ID NO: 22 - RNA, 23 nt, Homo sapiens
ggugcauuggagccuugccuugc

SEQ ID NO: 23 - RNA, 23 nt, Homo sapiens
gugcauuggagccuugccuugcu

SEQ ID NO: 24 - RNA, 23 nt, Homo sapiens
ugcauuggagccuugccuugcug

SEQ ID NO: 25 - RNA, 23 nt, Homo sapiens
gcauuggagccuugccuugcugc

SEQ ID NO: 26 - RNA, 23 nt, Homo sapiens
cauuggagccuugccuugcugcu

SEQ ID NO: 27 - RNA, 23 nt, Homo sapiens
auuggagccuugccuugcugcuc

SEQ ID NO: 28 - RNA, 23 nt, Homo sapiens
uuggagccuugccuugcugcucu

SEQ ID NO: 29 - RNA, 23 nt, Homo sapiens
uggagccuugccuugcugcucua

SEQ ID NO: 30 - RNA, 23 nt, Homo sapiens
ggagccuugccuugcugcucuac

SEQ ID NO: 31 - RNA, 23 nt, Homo sapiens
gagccuugccuugcugcucuacc

SEQ ID NO: 32 - RNA, 23 nt, Homo sapiens
agccuugccuugcugcucuaccu

SEQ ID NO: 33 - RNA, 23 nt, Homo sapiens
gccuugccuugcugcucuaccuc

SEQ ID NO: 34 - RNA, 23 nt, Homo sapiens
ccuugccuugcugcucuaccucc

SEQ ID NO: 35 - RNA, 23 nt, Homo sapiens
cuugccuugcugcucuaccucca

SEQ ID NO: 36 - RNA, 23 nt, Homo sapiens
uugccuugcugcucuaccuccac

SEQ ID NO: 37 - RNA, 23 nt, Homo sapiens
ugccuugcugcucuaccuccacc

SEQ ID NO: 38 - RNA, 23 nt, Homo sapiens
gccuugcugcucuaccuccacca

SEQ ID NO: 39 - RNA, 23 nt, Homo sapiens
ccuugcugcucuaccuccaccau

SEQ ID NO: 40 - RNA, 23 nt, Homo sapiens
cuugcugcucuaccuccaccaug

SEQ ID NO: 41 - RNA, 23 nt, Homo sapiens
uugcugcucuaccuccaccaugc

SEQ ID NO: 42 - RNA, 23 nt, Homo sapiens
ugcugcucuaccuccaccaugcc

SEQ ID NO: 43 - RNA, 23 nt, Homo sapiens
gcugcucuaccuccaccaugcca

SEQ ID NO: 44 - RNA, 23 nt, Homo sapiens
cugcucuaccuccaccaugccaa

SEQ ID NO: 45 - RNA, 23 nt, Homo sapiens
ugcucuaccuccaccaugccaag

SEQ ID NO: 46 - RNA, 23 nt, Homo sapiens
gcucuaccuccaccaugccaagu

SEQ ID NO: 47 - RNA, 23 nt, Homo sapiens
cucuaccuccaccaugccaagug

SEQ ID NO: 48 - RNA, 23 nt, Homo sapiens
ucuaccuccaccaugccaagugg

SEQ ID NO: 49 - RNA, 23 nt, Homo sapiens
cuaccuccaccaugccaaguggu

SEQ ID NO: 50 - RNA, 23 nt, Homo sapiens
uaccuccaccaugccaagugguc

SEQ ID NO: 51 - RNA, 23 nt, Homo sapiens
accuccaccaugccaaguggucc

SEQ ID NO: 52 - RNA, 23 nt, Homo sapiens
ccuccaccaugccaagugguccc

SEQ ID NO: 53 - RNA, 23 nt, Homo sapiens
cuccaccaugccaagugguccca

SEQ ID NO: 54 - RNA, 23 nt, Homo sapiens
uccaccaugccaaguggucccag

SEQ ID NO: 55 - RNA, 23 nt, Homo sapiens
ccaccaugccaaguggucccagg

SEQ ID NO: 56 - RNA, 23 nt, Homo sapiens
caccaugccaaguggucccaggc

SEQ ID NO: 57 - RNA, 23 nt, Homo sapiens
accaugccaaguggucccaggcu

SEQ ID NO: 58 - RNA, 23 nt, Homo sapiens
ccaugccaaguggucccaggcug

SEQ ID NO: 59 - RNA, 23 nt, Homo sapiens
caugccaaguggucccaggcugc

SEQ ID NO: 60 - RNA, 23 nt, Homo sapiens
augccaaguggucccaggcugca

SEQ ID NO: 61 - RNA, 23 nt, Homo sapiens
ugccaaguggucccaggcugcac

SEQ ID NO: 62 - RNA, 23 nt, Homo sapiens
gccaaguggucccaggcugcacc

SEQ ID NO: 63 - RNA, 23 nt, Homo sapiens
ccaaguggucccaggcugcaccc

SEQ ID NO: 64 - RNA, 23 nt, Homo sapiens
caaguggucccaggcugcaccca

SEQ ID NO: 65 - RNA, 23 nt, Homo sapiens
aaguggucccaggcugcacccau

SEQ ID NO: 66 - RNA, 23 nt, Homo sapiens
aguggucccaggcugcacccaug

SEQ ID NO: 67 - RNA, 23 nt, Homo sapiens
guggucccaggcugcacccaugg

SEQ ID NO: 68 - RNA, 23 nt, Homo sapiens
uggucccaggcugcacccauggc

SEQ ID NO: 69 - RNA, 23 nt, Homo sapiens
ggucccaggcugcacccauggca

SEQ ID NO: 70 - RNA, 23 nt, Homo sapiens
gucccaggcugcacccauggcag

SEQ ID NO: 71 - RNA, 23 nt, Homo sapiens
ucccaggcugcacccauggcaga

SEQ ID NO: 72 - RNA, 23 nt, Homo sapiens
cccaggcugcacccauggcagaa

SEQ ID NO: 73 - RNA, 23 nt, Homo sapiens
ccaggcugcacccauggcagaag

SEQ ID NO: 74 - RNA, 23 nt, Homo sapiens
caggcugcacccauggcagaagg

SEQ ID NO: 75 - RNA, 23 nt, Homo sapiens
aggcugcacccauggcagaagga

SEQ ID NO: 76 - RNA, 23 nt, Homo sapiens
ggcugcacccauggcagaaggag

SEQ ID NO: 77 - RNA, 23 nt, Homo sapiens
gcugcacccauggcagaaggagg

SEQ ID NO: 78 - RNA, 23 nt, Homo sapiens
cugcacccauggcagaaggagga

SEQ ID NO: 79 - RNA, 23 nt, Homo sapiens
ugcacccauggcagaaggaggag

SEQ ID NO: 80 - RNA, 23 nt, Homo sapiens
gcacccauggcagaaggaggagg

SEQ ID NO: 81 - RNA, 23 nt, Homo sapiens
cacccauggcagaaggaggaggg

SEQ ID NO: 82 - RNA, 23 nt, Homo sapiens
acccauggcagaaggaggagggc

SEQ ID NO: 83 - RNA, 23 nt, Homo sapiens
cccauggcagaaggaggagggca

SEQ ID NO: 84 - RNA, 23 nt, Homo sapiens
ccauggcagaaggaggagggcag

SEQ ID NO: 85 - RNA, 23 nt, Homo sapiens
cauggcagaaggaggagggcaga

SEQ ID NO: 86 - RNA, 23 nt, Homo sapiens
auggcagaaggaggagggcagaa

SEQ ID NO: 87 - RNA, 23 nt, Homo sapiens
uggcagaaggaggagggcagaau

SEQ ID NO: 88 - RNA, 23 nt, Homo sapiens
ggcagaaggaggagggcagaauc

SEQ ID NO: 89 - RNA, 23 nt, Homo sapiens
gcagaaggaggagggcagaauca

SEQ ID NO: 90 - RNA, 23 nt, Homo sapiens
cagaaggaggagggcagaaucau

SEQ ID NO: 91 - RNA, 23 nt, Homo sapiens
agaaggaggagggcagaaucauc

SEQ ID NO: 92 - RNA, 23 nt, Homo sapiens
gaaggaggagggcagaaucauca

SEQ ID NO: 93 - RNA, 23 nt, Homo sapiens
aaggaggagggcagaaucaucac

SEQ ID NO: 94 - RNA, 23 nt, Homo sapiens
aggaggagggcagaaucaucacg

SEQ ID NO: 95 - RNA, 23 nt, Homo sapiens
ggaggagggcagaaucaucacga

SEQ ID NO: 96 - RNA, 23 nt, Homo sapiens
gaggagggcagaaucaucacgaa

SEQ ID NO: 97 - RNA, 23 nt, Homo sapiens
aggagggcagaaucaucacgaag

SEQ ID NO: 98 - RNA, 23 nt, Homo sapiens
ggagggcagaaucaucacgaagu

SEQ ID NO: 99 - RNA, 23 nt, Homo sapiens
gagggcagaaucaucacgaagug

SEQ ID NO: 100 - RNA, 23 nt, Homo sapiens
agggcagaaucaucacgaagugg

SEQ ID NO: 101 - RNA, 23 nt, Homo sapiens
gggcagaaucaucacgaaguggu

SEQ ID NO: 102 - RNA, 23 nt, Homo sapiens
ggcagaaucaucacgaaguggug

SEQ ID NO: 103 - RNA, 23 nt, Homo sapiens
gcagaaucaucacgaagugguga

SEQ ID NO: 104 - RNA, 23 nt, Homo sapiens
cagaaucaucacgaaguggugaa

SEQ ID NO: 105 - RNA, 23 nt, Homo sapiens
agaaucaucacgaaguggugaag

SEQ ID NO: 106 - RNA, 23 nt, Homo sapiens
gaaucaucacgaaguggugaagu

SEQ ID NO: 107 - RNA, 23 nt, Homo sapiens
aaucaucacgaaguggugaaguu

SEQ ID NO: 108 - RNA, 23 nt, Homo sapiens
aucaucacgaaguggugaaguuc

SEQ ID NO: 109 - RNA, 23 nt, Homo sapiens
ucaucacgaaguggugaaguuca

SEQ ID NO: 110 - RNA, 23 nt, Homo sapiens
caucacgaaguggugaaguucau

SEQ ID NO: 111 - RNA, 23 nt, Homo sapiens
aucacgaaguggugaaguucaug

SEQ ID NO: 112 - RNA, 23 nt, Homo sapiens
ucacgaaguggugaaguucaugg

SEQ ID NO: 113 - RNA, 23 nt, Homo sapiens
cacgaaguggugaaguucaugga

SEQ ID NO: 114 - RNA, 23 nt, Homo sapiens
acgaaguggugaaguucauggau

SEQ ID NO: 115 - RNA, 23 nt, Homo sapiens
cgaaguggugaaguucauggaug

SEQ ID NO: 116 - RNA, 23 nt, Homo sapiens
gaaguggugaaguucauggaugu

SEQ ID NO: 117 - RNA, 23 nt, Homo sapiens
aaguggugaaguucauggauguc

SEQ ID NO: 118 - RNA, 23 nt, Homo sapiens
aguggugaaguucauggaugucu

SEQ ID NO: 119 - RNA, 23 nt, Homo sapiens
guggugaaguucauggaugucua

SEQ ID NO: 120 - RNA, 23 nt, Homo sapiens
uggugaaguucauggaugucuau

SEQ ID NO: 121 - RNA, 23 nt, Homo sapiens
ggugaaguucauggaugucuauc

SEQ ID NO: 122 - RNA, 23 nt, Homo sapiens
gugaaguucauggaugucuauca

SEQ ID NO: 123 - RNA, 23 nt, Homo sapiens
ugaaguucauggaugucuaucag

SEQ ID NO: 124 - RNA, 23 nt, Homo sapiens
gaaguucauggaugucuaucagc

SEQ ID NO: 125 - RNA, 23 nt, Homo sapiens
aaguucauggaugucuaucagcg

SEQ ID NO: 126 - RNA, 23 nt, Homo sapiens
aguucauggaugucuaucagcgc

SEQ ID NO: 127 - RNA, 23 nt, Homo sapiens
guucauggaugucuaucagcgca

SEQ ID NO: 128 - RNA, 23 nt, Homo sapiens
uucauggaugucuaucagcgcag

SEQ ID NO: 129 - RNA, 23 nt, Homo sapiens
ucauggaugucuaucagcgcagc

SEQ ID NO: 130 - RNA, 23 nt, Homo sapiens
cauggaugucuaucagcgcagcu

SEQ ID NO: 131 - RNA, 23 nt, Homo sapiens
auggaugucuaucagcgcagcua

SEQ ID NO: 132 - RNA, 23 nt, Homo sapiens
uggaugucuaucagcgcagcuac

SEQ ID NO: 133 - RNA, 23 nt, Homo sapiens
ggaugucuaucagcgcagcuacu

SEQ ID NO: 134 - RNA, 23 nt, Homo sapiens
gaugucuaucagcgcagcuacug

SEQ ID NO: 135 - RNA, 23 nt, Homo sapiens
augucuaucagcgcagcuacugc

SEQ ID NO: 136 - RNA, 23 nt, Homo sapiens
ugucuaucagcgcagcuacugcc

SEQ ID NO: 137 - RNA, 23 nt, Homo sapiens
gucuaucagcgcagcuacugcca

SEQ ID NO: 138 - RNA, 23 nt, Homo sapiens
ucuaucagcgcagcuacugccau

SEQ ID NO: 139 - RNA, 23 nt, Homo sapiens
cuaucagcgcagcuacugccauc

SEQ ID NO: 140 - RNA, 23 nt, Homo sapiens
uaucagcgcagcuacugccaucc

SEQ ID NO: 141 - RNA, 23 nt, Homo sapiens
aucagcgcagcuacugccaucca

SEQ ID NO: 142 - RNA, 23 nt, Homo sapiens
ucagcgcagcuacugccauccaa

SEQ ID NO: 143 - RNA, 23 nt, Homo sapiens
cagcgcagcuacugccauccaau

SEQ ID NO: 144 - RNA, 23 nt, Homo sapiens
agcgcagcuacugccauccaauc

SEQ ID NO: 145 - RNA, 23 nt, Homo sapiens
gcgcagcuacugccauccaaucg

SEQ ID NO: 146 - RNA, 23 nt, Homo sapiens
cgcagcuacugccauccaaucga

SEQ ID NO: 147 - RNA, 23 nt, Homo sapiens
gcagcuacugccauccaaucgag

SEQ ID NO: 148 - RNA, 23 nt, Homo sapiens
cagcuacugccauccaaucgaga

SEQ ID NO: 149 - RNA, 23 nt, Homo sapiens
agcuacugccauccaaucgagac

SEQ ID NO: 150 - RNA, 23 nt, Homo sapiens
gcuacugccauccaaucgagacc

SEQ ID NO: 151 - RNA, 23 nt, Homo sapiens
cuacugccauccaaucgagaccc

SEQ ID NO: 152 - RNA, 23 nt, Homo sapiens
uacugccauccaaucgagacccu

SEQ ID NO: 153 - RNA, 23 nt, Homo sapiens
acugccauccaaucgagacccug

SEQ ID NO: 154 - RNA, 23 nt, Homo sapiens
cugccauccaaucgagacccugg

SEQ ID NO: 155 - RNA, 23 nt, Homo sapiens
ugccauccaaucgagacccuggu

SEQ ID NO: 156 - RNA, 23 nt, Homo sapiens
gccauccaaucgagacccuggug

SEQ ID NO: 157 - RNA, 23 nt, Homo sapiens
ccauccaaucgagacccuggugg

SEQ ID NO: 158 - RNA, 23 nt, Homo sapiens
cauccaaucgagacccuggugga

SEQ ID NO: 159 - RNA, 23 nt, Homo sapiens
auccaaucgagacccugguggac

SEQ ID NO: 160 - RNA, 23 nt, Homo sapiens
uccaaucgagacccugguggaca

SEQ ID NO: 161 - RNA, 23 nt, Homo sapiens
ccaaucgagacccugguggacau

SEQ ID NO: 162 - RNA, 23 nt, Homo sapiens
caaucgagacccugguggacauc

SEQ ID NO: 163 - RNA, 23 nt, Homo sapiens
aaucgagacccugguggacaucu

SEQ ID NO: 164 - RNA, 23 nt, Homo sapiens
aucgagacccugguggacaucuu

SEQ ID NO: 165 - RNA, 23 nt, Homo sapiens
ucgagacccugguggacaucuuc

SEQ ID NO: 166 - RNA, 23 nt, Homo sapiens
cgagacccugguggacaucuucc

SEQ ID NO: 167 - RNA, 23 nt, Homo sapiens
gagacccugguggacaucuucca

SEQ ID NO: 168 - RNA, 23 nt, Homo sapiens
agacccugguggacaucuuccag

SEQ ID NO: 169 - RNA, 23 nt, Homo sapiens
gacccugguggacaucuuccagg

SEQ ID NO: 170 - RNA, 23 nt, Homo sapiens
acccugguggacaucuuccagga

SEQ ID NO: 171 - RNA, 23 nt, Homo sapiens
cccugguggacaucuuccaggag

SEQ ID NO: 172 - RNA, 23 nt, Homo sapiens
ccugguggacaucuuccaggagu

SEQ ID NO: 173 - RNA, 23 nt, Homo sapiens
cugguggacaucuuccaggagua

SEQ ID NO: 174 - RNA, 23 nt, Homo sapiens
ugguggacaucuuccaggaguac

SEQ ID NO: 175 - RNA, 23 nt, Homo sapiens
gguggacaucuuccaggaguacc

SEQ ID NO: 176 - RNA, 23 nt, Homo sapiens
guggacaucuuccaggaguaccc

SEQ ID NO: 177 - RNA, 23 nt, Homo sapiens
uggacaucuuccaggaguacccu

SEQ ID NO: 178 - RNA, 23 nt, Homo sapiens
ggacaucuuccaggaguacccug

SEQ ID NO: 179 - RNA, 23 nt, Homo sapiens
gacaucuuccaggaguacccuga

SEQ ID NO: 180 - RNA, 23 nt, Homo sapiens
acaucuuccaggaguacccugau

SEQ ID NO: 181 - RNA, 23 nt, Homo sapiens
caucuuccaggaguacccugaug

SEQ ID NO: 182 - RNA, 23 nt, Homo sapiens
aucuuccaggaguacccugauga

SEQ ID NO: 183 - RNA, 23 nt, Homo sapiens
ucuuccaggaguacccugaugag

SEQ ID NO: 184 - RNA, 23 nt, Homo sapiens
cuuccaggaguacccugaugaga

SEQ ID NO: 185 - RNA, 23 nt, Homo sapiens
uuccaggaguacccugaugagau

SEQ ID NO: 186 - RNA, 23 nt, Homo sapiens
uccaggaguacccugaugagauc

SEQ ID NO: 187 - RNA, 23 nt, Homo sapiens
ccaggaguacccugaugagaucg

SEQ ID NO: 188 - RNA, 23 nt, Homo sapiens
caggaguacccugaugagaucga

SEQ ID NO: 189 - RNA, 23 nt, Homo sapiens
aggaguacccugaugagaucgag

SEQ ID NO: 190 - RNA, 23 nt, Homo sapiens
ggaguacccugaugagaucgagu

SEQ ID NO: 191 - RNA, 23 nt, Homo sapiens
gaguacccugaugagaucgagua

SEQ ID NO: 192 - RNA, 23 nt, Homo sapiens
aguacccugaugagaucgaguac

SEQ ID NO: 193 - RNA, 23 nt, Homo sapiens
guacccugaugagaucgaguaca

SEQ ID NO: 194 - RNA, 23 nt, Homo sapiens
uacccugaugagaucgaguacau

SEQ ID NO: 195 - RNA, 23 nt, Homo sapiens
acccugaugagaucgaguacauc

SEQ ID NO: 196 - RNA, 23 nt, Homo sapiens
cccugaugagaucgaguacaucu

SEQ ID NO: 197 - RNA, 23 nt, Homo sapiens
ccugaugagaucgaguacaucuu

SEQ ID NO: 198 - RNA, 23 nt, Homo sapiens
cugaugagaucgaguacaucuuc

SEQ ID NO: 199 - RNA, 23 nt, Homo sapiens
ugaugagaucgaguacaucuuca

SEQ ID NO: 200 - RNA, 23 nt, Homo sapiens
gaugagaucgaguacaucuucaa

SEQ ID NO: 201 - RNA, 23 nt, Homo sapiens
augagaucgaguacaucuucaag

SEQ ID NO: 202 - RNA, 23 nt, Homo sapiens
ugagaucgaguacaucuucaagc

SEQ ID NO: 203 - RNA, 23 nt, Homo sapiens
gagaucgaguacaucuucaagcc

SEQ ID NO: 204 - RNA, 23 nt, Homo sapiens
agaucgaguacaucuucaagcca

SEQ ID NO: 205 - RNA, 23 nt, Homo sapiens
gaucgaguacaucuucaagccau

SEQ ID NO: 206 - RNA, 23 nt, Homo sapiens
aucgaguacaucuucaagccauc

SEQ ID NO: 207 - RNA, 23 nt, Homo sapiens
ucgaguacaucuucaagccaucc

SEQ ID NO: 208 - RNA, 23 nt, Homo sapiens
cgaguacaucuucaagccauccu

SEQ ID NO: 209 - RNA, 23 nt, Homo sapiens
gaguacaucuucaagccauccug

SEQ ID NO: 210 - RNA, 23 nt, Homo sapiens
aguacaucuucaagccauccugu

SEQ ID NO: 211 - RNA, 23 nt, Homo sapiens
guacaucuucaagccauccugug

SEQ ID NO: 212 - RNA, 23 nt, Homo sapiens
uacaucuucaagccauccugugu

SEQ ID NO: 213 - RNA, 23 nt, Homo sapiens
acaucuucaagccauccugugug

SEQ ID NO: 214 - RNA, 23 nt, Homo sapiens
caucuucaagccauccugugugc

SEQ ID NO: 215 - RNA, 23 nt, Homo sapiens
aucuucaagccauccugugugcc

SEQ ID NO: 216 - RNA, 23 nt, Homo sapiens
ucuucaagccauccugugugccc

SEQ ID NO: 217 - RNA, 23 nt, Homo sapiens
cuucaagccauccugugugcccc

SEQ ID NO: 218 - RNA, 23 nt, Homo sapiens
uucaagccauccugugugccccu

SEQ ID NO: 219 - RNA, 23 nt, Homo sapiens
ucaagccauccugugugccccug

SEQ ID NO: 220 - RNA, 23 nt, Homo sapiens
caagccauccugugugccccuga

SEQ ID NO: 221 - RNA, 23 nt, Homo sapiens
aagccauccugugugccccugau

SEQ ID NO: 222 - RNA, 23 nt, Homo sapiens
agccauccugugugccccugaug

SEQ ID NO: 223 - RNA, 23 nt, Homo sapiens
gccauccugugugccccugaugc

SEQ ID NO: 224 - RNA, 23 nt, Homo sapiens
ccauccugugugccccugaugcg

SEQ ID NO: 225 - RNA, 23 nt, Homo sapiens
cauccugugugccccugaugcga

SEQ ID NO: 226 - RNA, 23 nt, Homo sapiens
auccugugugccccugaugcgau

SEQ ID NO: 227 - RNA, 23 nt, Homo sapiens
uccugugugccccugaugcgaug

SEQ ID NO: 228 - RNA, 23 nt, Homo sapiens
ccugugugccccugaugcgaugc

SEQ ID NO: 229 - RNA, 23 nt, Homo sapiens
cugugugccccugaugcgaugcg

SEQ ID NO: 230 - RNA, 23 nt, Homo sapiens
ugugugccccugaugcgaugcgg

SEQ ID NO: 231 - RNA, 23 nt, Homo sapiens
gugugccccugaugcgaugcggg

SEQ ID NO: 232 - RNA, 23 nt, Homo sapiens
ugugccccugaugcgaugcgggg

SEQ ID NO: 233 - RNA, 23 nt, Homo sapiens
gugccccugaugcgaugcggggg

SEQ ID NO: 234 - RNA, 23 nt, Homo sapiens
ugccccugaugcgaugcgggggc

SEQ ID NO: 235 - RNA, 23 nt, Homo sapiens
gccccugaugcgaugcgggggcu

SEQ ID NO: 236 - RNA, 23 nt, Homo sapiens
ccccugaugcgaugcgggggcug

SEQ ID NO: 237 - RNA, 23 nt, Homo sapiens
cccugaugcgaugcgggggcugc

SEQ ID NO: 238 - RNA, 23 nt, Homo sapiens
ccugaugcgaugcgggggcugcu

SEQ ID NO: 239 - RNA, 23 nt, Homo sapiens
cugaugcgaugcgggggcugcug

SEQ ID NO: 240 - RNA, 23 nt, Homo sapiens
ugaugcgaugcgggggcugcugc

SEQ ID NO: 241 - RNA, 23 nt, Homo sapiens
gaugcgaugcgggggcugcugca

SEQ ID NO: 242 - RNA, 23 nt, Homo sapiens
augcgaugcgggggcugcugcaa

SEQ ID NO: 243 - RNA, 23 nt, Homo sapiens
ugcgaugcgggggcugcugcaau

SEQ ID NO: 244 - RNA, 23 nt, Homo sapiens
gcgaugcgggggcugcugcaaug

SEQ ID NO: 245 - RNA, 23 nt, Homo sapiens
cgaugcgggggcugcugcaauga

SEQ ID NO: 246 - RNA, 23 nt, Homo sapiens
gaugcgggggcugcugcaaugac

SEQ ID NO: 247 - RNA, 23 nt, Homo sapiens
augcgggggcugcugcaaugacg

SEQ ID NO: 248 - RNA, 23 nt, Homo sapiens
ugcgggggcugcugcaaugacga

SEQ ID NO: 249 - RNA, 23 nt, Homo sapiens
gcgggggcugcugcaaugacgag

SEQ ID NO: 250 - RNA, 23 nt, Homo sapiens
cgggggcugcugcaaugacgagg

SEQ ID NO: 251 - RNA, 23 nt, Homo sapiens
gggggcugcugcaaugacgaggg

SEQ ID NO: 252 - RNA, 23 nt, Homo sapiens
ggggcugcugcaaugacgagggc

SEQ ID NO: 253 - RNA, 23 nt, Homo sapiens
gggcugcugcaaugacgagggcc

SEQ ID NO: 254 - RNA, 23 nt, Homo sapiens
ggcugcugcaaugacgagggccu

SEQ ID NO: 255 - RNA, 23 nt, Homo sapiens
gcugcugcaaugacgagggccug

SEQ ID NO: 256 - RNA, 23 nt, Homo sapiens
cugcugcaaugacgagggccugg

SEQ ID NO: 257 - RNA, 23 nt, Homo sapiens
ugcugcaaugacgagggccugga

SEQ ID NO: 258 - RNA, 23 nt, Homo sapiens
gcugcaaugacgagggccuggag

SEQ ID NO: 259 - RNA, 23 nt, Homo sapiens
cugcaaugacgagggccuggagu

SEQ ID NO: 260 - RNA, 23 nt, Homo sapiens
ugcaaugacgagggccuggagug

SEQ ID NO: 261 - RNA, 23 nt, Homo sapiens
gcaaugacgagggccuggagugu

SEQ ID NO: 262 - RNA, 23 nt, Homo sapiens
caaugacgagggccuggagugug

SEQ ID NO: 263 - RNA, 23 nt, Homo sapiens
aaugacgagggccuggagugugu

SEQ ID NO: 264 - RNA, 23 nt, Homo sapiens
augacgagggccuggagugugug

SEQ ID NO: 265 - RNA, 23 nt, Homo sapiens
ugacgagggccuggagugugugc

SEQ ID NO: 266 - RNA, 23 nt, Homo sapiens
gacgagggccuggagugugugcc

SEQ ID NO: 267 - RNA, 23 nt, Homo sapiens
acgagggccuggagugugugccc

SEQ ID NO: 268 - RNA, 23 nt, Homo sapiens
cgagggccuggagugugugccca

SEQ ID NO: 269 - RNA, 23 nt, Homo sapiens
gagggccuggagugugugcccac

SEQ ID NO: 270 - RNA, 23 nt, Homo sapiens
agggccuggagugugugcccacu

SEQ ID NO: 271 - RNA, 23 nt, Homo sapiens
gggccuggagugugugcccacug

SEQ ID NO: 272 - RNA, 23 nt, Homo sapiens
ggccuggagugugugcccacuga

SEQ ID NO: 273 - RNA, 23 nt, Homo sapiens
gccuggagugugugcccacugag

SEQ ID NO: 274 - RNA, 23 nt, Homo sapiens
ccuggagugugugcccacugagg

SEQ ID NO: 275 - RNA, 23 nt, Homo sapiens
cuggagugugugcccacugagga

SEQ ID NO: 276 - RNA, 23 nt, Homo sapiens
uggagugugugcccacugaggag

SEQ ID NO: 277 - RNA, 23 nt, Homo sapiens
ggagugugugcccacugaggagu

SEQ ID NO: 278 - RNA, 23 nt, Homo sapiens
gagugugugcccacugaggaguc

SEQ ID NO: 279 - RNA, 23 nt, Homo sapiens
agugugugcccacugaggagucc

SEQ ID NO: 280 - RNA, 23 nt, Homo sapiens
gugugugcccacugaggagucca

SEQ ID NO: 281 - RNA, 23 nt, Homo sapiens
ugugugcccacugaggaguccaa

SEQ ID NO: 282 - RNA, 23 nt, Homo sapiens
gugugcccacugaggaguccaac

SEQ ID NO: 283 - RNA, 23 nt, Homo sapiens
ugugcccacugaggaguccaaca

SEQ ID NO: 284 - RNA, 23 nt, Homo sapiens
gugcccacugaggaguccaacau

SEQ ID NO: 285 - RNA, 23 nt, Homo sapiens
ugcccacugaggaguccaacauc

SEQ ID NO: 286 - RNA, 23 nt, Homo sapiens
gcccacugaggaguccaacauca

SEQ ID NO: 287 - RNA, 23 nt, Homo sapiens
cccacugaggaguccaacaucac

SEQ ID NO: 288 - RNA, 23 nt, Homo sapiens
ccacugaggaguccaacaucacc

SEQ ID NO: 289 - RNA, 23 nt, Homo sapiens
cacugaggaguccaacaucacca

SEQ ID NO: 290 - RNA, 23 nt, Homo sapiens
acugaggaguccaacaucaccau

SEQ ID NO: 291 - RNA, 23 nt, Homo sapiens
cugaggaguccaacaucaccaug

SEQ ID NO: 292 - RNA, 23 nt, Homo sapiens
ugaggaguccaacaucaccaugc

SEQ ID NO: 293 - RNA, 23 nt, Homo sapiens
gaggaguccaacaucaccaugca

SEQ ID NO: 294 - RNA, 23 nt, Homo sapiens
aggaguccaacaucaccaugcag

SEQ ID NO: 295 - RNA, 23 nt, Homo sapiens
ggaguccaacaucaccaugcaga

SEQ ID NO: 296 - RNA, 23 nt, Homo sapiens
gaguccaacaucaccaugcagau

SEQ ID NO: 297 - RNA, 23 nt, Homo sapiens
aguccaacaucaccaugcagauu

SEQ ID NO: 298 - RNA, 23 nt, Homo sapiens
guccaacaucaccaugcagauua

SEQ ID NO: 299 - RNA, 23 nt, Homo sapiens
uccaacaucaccaugcagauuau

SEQ ID NO: 300 - RNA, 23 nt, Homo sapiens
ccaacaucaccaugcagauuaug

SEQ ID NO: 301 - RNA, 23 nt, Homo sapiens
caacaucaccaugcagauuaugc

SEQ ID NO: 302 - RNA, 23 nt, Homo sapiens
aacaucaccaugcagauuaugcg

SEQ ID NO: 303 - RNA, 23 nt, Homo sapiens
acaucaccaugcagauuaugcgg

SEQ ID NO: 304 - RNA, 23 nt, Homo sapiens
caucaccaugcagauuaugcgga

SEQ ID NO: 305 - RNA, 23 nt, Homo sapiens
aucaccaugcagauuaugcggau

SEQ ID NO: 306 - RNA, 23 nt, Homo sapiens
ucaccaugcagauuaugcggauc

SEQ ID NO: 307 - RNA, 23 nt, Homo sapiens
caccaugcagauuaugcggauca

SEQ ID NO: 308 - RNA, 23 nt, Homo sapiens
accaugcagauuaugcggaucaa

SEQ ID NO: 309 - RNA, 23 nt, Homo sapiens
ccaugcagauuaugcggaucaaa

SEQ ID NO: 310 - RNA, 23 nt, Homo sapiens
caugcagauuaugcggaucaaac

SEQ ID NO: 311 - RNA, 23 nt, Homo sapiens
augcagauuaugcggaucaaacc

SEQ ID NO: 312 - RNA, 23 nt, Homo sapiens
ugcagauuaugcggaucaaaccu

SEQ ID NO: 313 - RNA, 23 nt, Homo sapiens
gcagauuaugcggaucaaaccuc

SEQ ID NO: 314 - RNA, 23 nt, Homo sapiens
cagauuaugcggaucaaaccuca

SEQ ID NO: 315 - RNA, 23 nt, Homo sapiens
agauuaugcggaucaaaccucac

SEQ ID NO: 316 - RNA, 23 nt, Homo sapiens
gauuaugcggaucaaaccucacc

SEQ ID NO: 317 - RNA, 23 nt, Homo sapiens
auuaugcggaucaaaccucacca

SEQ ID NO: 318 - RNA, 23 nt, Homo sapiens
uuaugcggaucaaaccucaccaa

SEQ ID NO: 319 - RNA, 23 nt, Homo sapiens
uaugcggaucaaaccucaccaag

SEQ ID NO: 320 - RNA, 23 nt, Homo sapiens
augcggaucaaaccucaccaagg

SEQ ID NO: 321 - RNA, 23 nt, Homo sapiens
ugcggaucaaaccucaccaaggc

SEQ ID NO: 322 - RNA, 23 nt, Homo sapiens
gcggaucaaaccucaccaaggcc

SEQ ID NO: 323 - RNA, 23 nt, Homo sapiens
cggaucaaaccucaccaaggcca

SEQ ID NO: 324 - RNA, 23 nt, Homo sapiens
ggaucaaaccucaccaaggccag

SEQ ID NO: 325 - RNA, 23 nt, Homo sapiens
gaucaaaccucaccaaggccagc

SEQ ID NO: 326 - RNA, 23 nt, Homo sapiens
aucaaaccucaccaaggccagca

SEQ ID NO: 327 - RNA, 23 nt, Homo sapiens
ucaaaccucaccaaggccagcac

SEQ ID NO: 328 - RNA, 23 nt, Homo sapiens
caaaccucaccaaggccagcaca

SEQ ID NO: 329 - RNA, 23 nt, Homo sapiens
aaaccucaccaaggccagcacau

SEQ ID NO: 330 - RNA, 23 nt, Homo sapiens
aaccucaccaaggccagcacaua

SEQ ID NO: 331 - RNA, 23 nt, Homo sapiens
accucaccaaggccagcacauag

SEQ ID NO: 332 - RNA, 23 nt, Homo sapiens
ccucaccaaggccagcacauagg

SEQ ID NO: 333 - RNA, 23 nt, Homo sapiens
cucaccaaggccagcacauagga

SEQ ID NO: 334 - RNA, 23 nt, Homo sapiens
ucaccaaggccagcacauaggag

SEQ ID NO: 335 - RNA, 23 nt, Homo sapiens
caccaaggccagcacauaggaga

SEQ ID NO: 336 - RNA, 23 nt, Homo sapiens
accaaggccagcacauaggagag

SEQ ID NO: 337 - RNA, 23 nt, Homo sapiens
ccaaggccagcacauaggagaga

SEQ ID NO: 338 - RNA, 23 nt, Homo sapiens
caaggccagcacauaggagagau

SEQ ID NO: 339 - RNA, 23 nt, Homo sapiens
aaggccagcacauaggagagaug

SEQ ID NO: 340 - RNA, 23 nt, Homo sapiens
aggccagcacauaggagagauga

SEQ ID NO: 341 - RNA, 23 nt, Homo sapiens
ggccagcacauaggagagaugag

SEQ ID NO: 342 - RNA, 23 nt, Homo sapiens
gccagcacauaggagagaugagc

SEQ ID NO: 343 - RNA, 23 nt, Homo sapiens
ccagcacauaggagagaugagcu

SEQ ID NO: 344 - RNA, 23 nt, Homo sapiens
cagcacauaggagagaugagcuu

SEQ ID NO: 345 - RNA, 23 nt, Homo sapiens
agcacauaggagagaugagcuuc

SEQ ID NO: 346 - RNA, 23 nt, Homo sapiens
gcacauaggagagaugagcuucc

SEQ ID NO: 347 - RNA, 23 nt, Homo sapiens
cacauaggagagaugagcuuccu

SEQ ID NO: 348 - RNA, 23 nt, Homo sapiens
acauaggagagaugagcuuccua

SEQ ID NO: 349 - RNA, 23 nt, Homo sapiens
cauaggagagaugagcuuccuac

SEQ ID NO: 350 - RNA, 23 nt, Homo sapiens
auaggagagaugagcuuccuaca

SEQ ID NO: 351 - RNA, 23 nt, Homo sapiens
uaggagagaugagcuuccuacag

SEQ ID NO: 352 - RNA, 23 nt, Homo sapiens
aggagagaugagcuuccuacagc

SEQ ID NO: 353 - RNA, 23 nt, Homo sapiens
ggagagaugagcuuccuacagca

SEQ ID NO: 354 - RNA, 23 nt, Homo sapiens
gagagaugagcuuccuacagcac

SEQ ID NO: 355 - RNA, 23 nt, Homo sapiens
agagaugagcuuccuacagcaca

SEQ ID NO: 356 - RNA, 23 nt, Homo sapiens
gagaugagcuuccuacagcacaa

SEQ ID NO: 357 - RNA, 23 nt, Homo sapiens
agaugagcuuccuacagcacaac

SEQ ID NO: 358 - RNA, 23 nt, Homo sapiens
gaugagcuuccuacagcacaaca

SEQ ID NO: 359 - RNA, 23 nt, Homo sapiens
augagcuuccuacagcacaacaa

SEQ ID NO: 360 - RNA, 23 nt, Homo sapiens
ugagcuuccuacagcacaacaaa

SEQ ID NO: 361 - RNA, 23 nt, Homo sapiens
gagcuuccuacagcacaacaaau

SEQ ID NO: 362 - RNA, 23 nt, Homo sapiens
agcuuccuacagcacaacaaaug

SEQ ID NO: 363 - RNA, 23 nt, Homo sapiens
gcuuccuacagcacaacaaaugu

SEQ ID NO: 364 - RNA, 23 nt, Homo sapiens
cuuccuacagcacaacaaaugug

SEQ ID NO: 365 - RNA, 23 nt, Homo sapiens
uuccuacagcacaacaaauguga

SEQ ID NO: 366 - RNA, 23 nt, Homo sapiens
uccuacagcacaacaaaugugaa

SEQ ID NO: 367 - RNA, 23 nt, Homo sapiens
ccuacagcacaacaaaugugaau

SEQ ID NO: 368 - RNA, 23 nt, Homo sapiens
cuacagcacaacaaaugugaaug

SEQ ID NO: 369 - RNA, 23 nt, Homo sapiens
uacagcacaacaaaugugaaugc

SEQ ID NO: 370 - RNA, 23 nt, Homo sapiens
acagcacaacaaaugugaaugca

SEQ ID NO: 371 - RNA, 23 nt, Homo sapiens
cagcacaacaaaugugaaugcag

SEQ ID NO: 372 - RNA, 23 nt, Homo sapiens
agcacaacaaaugugaaugcaga

SEQ ID NO: 373 - RNA, 23 nt, Homo sapiens
gcacaacaaaugugaaugcagac

SEQ ID NO: 374 - RNA, 23 nt, Homo sapiens
cacaacaaaugugaaugcagacc

SEQ ID NO: 375 - RNA, 23 nt, Homo sapiens
acaacaaaugugaaugcagacca

SEQ ID NO: 376 - RNA, 23 nt, Homo sapiens
caacaaaugugaaugcagaccaa

SEQ ID NO: 377 - RNA, 23 nt, Homo sapiens
aacaaaugugaaugcagaccaaa

SEQ ID NO: 378 - RNA, 23 nt, Homo sapiens
acaaaugugaaugcagaccaaag

SEQ ID NO: 379 - RNA, 23 nt, Homo sapiens
caaaugugaaugcagaccaaaga

SEQ ID NO: 380 - RNA, 23 nt, Homo sapiens
aaaugugaaugcagaccaaagaa

SEQ ID NO: 381 - RNA, 23 nt, Homo sapiens
aaugugaaugcagaccaaagaaa

SEQ ID NO: 382 - RNA, 23 nt, Homo sapiens
augugaaugcagaccaaagaaag

SEQ ID NO: 383 - RNA, 23 nt, Homo sapiens
ugugaaugcagaccaaagaaaga

SEQ ID NO: 384 - RNA, 23 nt, Homo sapiens
gugaaugcagaccaaagaaagau

SEQ ID NO: 385 - RNA, 23 nt, Homo sapiens
ugaaugcagaccaaagaaagaua

SEQ ID NO: 386 - RNA, 23 nt, Homo sapiens
gaaugcagaccaaagaaagauag

SEQ ID NO: 387 - RNA, 23 nt, Homo sapiens
aaugcagaccaaagaaagauaga

SEQ ID NO: 388 - RNA, 23 nt, Homo sapiens
augcagaccaaagaaagauagag

SEQ ID NO: 389 - RNA, 23 nt, Homo sapiens
ugcagaccaaagaaagauagagc

SEQ ID NO: 390 - RNA, 23 nt, Homo sapiens
gcagaccaaagaaagauagagca

SEQ ID NO: 391 - RNA, 23 nt, Homo sapiens
cagaccaaagaaagauagagcaa

SEQ ID NO: 392 - RNA, 23 nt, Homo sapiens
agaccaaagaaagauagagcaag

SEQ ID NO: 393 - RNA, 23 nt, Homo sapiens
gaccaaagaaagauagagcaaga

SEQ ID NO: 394 - RNA, 23 nt, Homo sapiens
accaaagaaagauagagcaagac

SEQ ID NO: 395 - RNA, 23 nt, Homo sapiens
ccaaagaaagauagagcaagaca

SEQ ID NO: 396 - RNA, 23 nt, Homo sapiens
caaagaaagauagagcaagacaa

SEQ ID NO: 397 - RNA, 23 nt, Homo sapiens
aaagaaagauagagcaagacaag

SEQ ID NO: 398 - RNA, 23 nt, Homo sapiens
aagaaagauagagcaagacaaga

SEQ ID NO: 399 - RNA, 23 nt, Homo sapiens
agaaagauagagcaagacaagaa

SEQ ID NO: 400 - RNA, 23 nt, Homo sapiens
gaaagauagagcaagacaagaaa

SEQ ID NO: 401 - RNA, 23 nt, Homo sapiens
aaagauagagcaagacaagaaaa

SEQ ID NO: 402 - RNA, 21 nt, Artificial Sequence
  Description of Artificial Sequence: Synthetic oligonucleotide
gaacuuucugcugucuugggu

SEQ ID NO: 403 - RNA, 23 nt, Artificial Sequence
  Description of Artificial Sequence: Synthetic oligonucleotide
acccaagacagcagaaaguucau

SEQ ID NO: 404 - RNA, 21 nt, Artificial Sequence
  Description of Artificial Sequence: Synthetic oligonucleotide
gcauuggagccuugccuugcu

SEQ ID NO: 405 - RNA, 23 nt, Artificial Sequence
  Description of Artificial Sequence: Synthetic oligonucleotide
agcaaggcaaggcuccaaugcac

SEQ ID NO: 406 - DNA, 21 bp, Artificial Sequence
  Description of Combined DNA/RNA molecule: Synthetic oligonucleotide
  Description of Artificial Sequence: Synthetic oligonucleotide
uaccuccaccaugccaagutt

SEQ ID NO: 407 - DNA, 21 bp, Artificial Sequence
  Description of Combined DNA/RNA molecule: Synthetic oligonucleotide
  Description of Artificial Sequence: Synthetic oligonucleotide
acuuggcaugguggagguatt

SEQ ID NO: 408 - DNA, 21 bp, Artificial Sequence
  Description of Combined DNA/RNA molecule: Synthetic oligonucleotide
  Description of Artificial Sequence: Synthetic oligonucleotide
accuccaccaugccaagugtt

SEQ ID NO: 409 - DNA, 21 bp, Artificial Sequence
  Description of Combined DNA/RNA molecule: Synthetic oligonucleotide
  Description of Artificial Sequence: Synthetic oligonucleotide
cacuuggcaugguggaggutt

SEQ ID NO: 410 - RNA, 21 nt, Artificial Sequence
  Description of Artificial Sequence: Synthetic oligonucleotide
cuccaccaugccaaguggucc

SEQ ID NO: 411 - RNA, 23 nt, Artificial Sequence
  Description of Artificial Sequence: Synthetic oligonucleotide
ggaccacuuggcaugguggaggu

SEQ ID NO: 412 - DNA, 21 bp, Artificial Sequence
  Description of Combined DNA/RNA molecule: Synthetic oligonucleotide
  Description of Artificial Sequence: Synthetic oligonucleotide
cuccaccaugccaaguggutt

SEQ ID NO: 413 - DNA, 21 bp, Artificial Sequence
  Description of Combined DNA/RNA molecule: Synthetic oligonucleotide
  Description of Artificial Sequence: Synthetic oligonucleotide
accacuuggcaugguggagtt

SEQ ID NO: 414 - RNA, 21 nt, Artificial Sequence
  Description of Artificial Sequence: Synthetic oligonucleotide
uccaccaugccaagugguccc

SEQ ID NO: 415 - RNA, 23 nt, Artificial Sequence
  Description of Artificial Sequence: Synthetic oligonucleotide
gggaccacuuggcaugguggagg

SEQ ID NO: 416 - DNA, 21 bp, Artificial Sequence
  Description of Combined DNA/RNA molecule: Synthetic oligonucleotide
  Description of Artificial Sequence: Synthetic oligonucleotide
uccaccaugccaagugguctt

SEQ ID NO: 417 - DNA, 21 bp, Artificial Sequence
  Description of Combined DNA/RNA molecule: Synthetic oligonucleotide
  Description of Artificial Sequence: Synthetic oligonucleotide
gaccacuuggcaugguggatt

SEQ ID NO: 418 - RNA, 21 nt, Artificial Sequence
  Description of Artificial Sequence: Synthetic oligonucleotide
ccaccaugccaagugguccca

SEQ ID NO: 419 - RNA, 23 nt, Artificial Sequence
  Description of Artificial Sequence: Synthetic oligonucleotide
ugggaccacuuggcaugguggag

SEQ ID NO: 420 - DNA, 21 bp, Artificial Sequence
  Description of Combined DNA/RNA molecule: Synthetic oligonucleotide
  Description of Artificial Sequence: Synthetic oligonucleotide
ccaccaugccaaguggucctt

SEQ ID NO: 421 - DNA, 21 bp, Artificial Sequence
  Description of Combined DNA/RNA molecule: Synthetic oligonucleotide
  Description of Artificial Sequence: Synthetic oligonucleotide
ggaccacuuggcaugguggtt

SEQ ID NO: 422 - RNA, 21 nt, Artificial Sequence
  Description of Artificial Sequence: Synthetic oligonucleotide
caccaugccaaguggucccag

SEQ ID NO: 423 - RNA, 23 nt, Artificial Sequence
  Description of Artificial Sequence: Synthetic oligonucleotide
cugggaccacuuggcauggugga

SEQ ID NO: 424 - DNA, 21 bp, Artificial Sequence
  Description of Combined DNA/RNA molecule: Synthetic oligonucleotide
  Description of Artificial Sequence: Synthetic oligonucleotide
caccaugccaagugguccctt

SEQ ID NO: 425 - DNA, 21 bp, Artificial Sequence
  Description of Combined DNA/RNA molecule: Synthetic oligonucleotide
  Description of Artificial Sequence: Synthetic oligonucleotide
gggaccacuuggcauggugtt

SEQ ID NO: 426 - RNA, 21 nt, Artificial Sequence
  Description of Artificial Sequence: Synthetic oligonucleotide
accaugccaaguggucccagg

SEQ ID NO: 427 - RNA, 23 nt, Artificial Sequence
  Description of Artificial Sequence: Synthetic oligonucleotide
ccugggaccacuuggcauggugg

SEQ ID NO: 428 - DNA, 21 bp, Artificial Sequence
  Description of Combined DNA/RNA molecule: Synthetic oligonucleotide
  Description of Artificial Sequence: Synthetic oligonucleotide
accaugccaaguggucccatt

SEQ ID NO: 429 - DNA, 21 bp, Artificial Sequence
  Description of Combined DNA/RNA molecule: Synthetic oligonucleotide
  Description of Artificial Sequence: Synthetic oligonucleotide
ugggaccacuuggcauggutt

SEQ ID NO: 430 - RNA, 21 nt, Artificial Sequence
  Description of Artificial Sequence: Synthetic oligonucleotide
ccaugccaaguggucccaggc

SEQ ID NO: 431 - RNA, 23 nt, Artificial Sequence
  Description of Artificial Sequence: Synthetic oligonucleotide
gccugggaccacuuggcauggug

SEQ ID NO: 432 - DNA, 21 bp, Artificial Sequence
  Description of Combined DNA/RNA molecule: Synthetic oligonucleotide
  Description of Artificial Sequence: Synthetic oligonucleotide
ccaugccaaguggucccagtt

SEQ ID NO: 433 - DNA, 21 bp, Artificial Sequence
  Description of Combined DNA/RNA molecule: Synthetic oligonucleotide
  Description of Artificial Sequence: Synthetic oligonucleotide
cugggaccacuuggcauggtt

SEQ ID NO: 434 - RNA, 21 nt, Artificial Sequence
  Description of Artificial Sequence: Synthetic oligonucleotide
caugccaaguggucccaggcu

SEQ ID NO: 435 - RNA, 23 nt, Artificial Sequence
  Description of Artificial Sequence: Synthetic oligonucleotide
agccugggaccacuuggcauggu

SEQ ID NO: 436 - DNA, 21 bp, Artificial Sequence
  Description of Combined DNA/RNA molecule: Synthetic oligonucleotide
  Description of Artificial Sequence: Synthetic oligonucleotide
caugccaaguggucccaggtt

SEQ ID NO: 437 - DNA, 21 bp, Artificial Sequence
  Description of Combined DNA/RNA molecule: Synthetic oligonucleotide
  Description of Artificial Sequence: Synthetic oligonucleotide
ccugggaccacuuggcaugtt

SEQ ID NO: 438 - RNA, 21 nt, Artificial Sequence
  Description of Artificial Sequence: Synthetic oligonucleotide
augccaaguggucccaggcug

SEQ ID NO: 439 - RNA, 23 nt, Artificial Sequence
  Description of Artificial Sequence: Synthetic oligonucleotide
cagccugggaccacuuggcaugg

SEQ ID NO: 440 - DNA, 21 bp, Artificial Sequence
  Description of Combined DNA/RNA molecule: Synthetic oligonucleotide
  Description of Artificial Sequence: Synthetic oligonucleotide
augccaaguggucccaggctt

SEQ ID NO: 441 - DNA, 21 bp, Artificial Sequence
  Description of Combined DNA/RNA molecule: Synthetic oligonucleotide
  Description of Artificial Sequence: Synthetic oligonucleotide
gccugggaccacuuggcautt

SEQ ID NO: 442 - RNA, 21 nt, Artificial Sequence
  Description of Artificial Sequence: Synthetic oligonucleotide
ugccaaguggucccaggcugc

SEQ ID NO: 443 - RNA, 23 nt, Artificial Sequence
  Description of Artificial Sequence: Synthetic oligonucleotide
gcagccugggaccacuuggcaug

SEQ ID NO: 444 - DNA, 21 bp, Artificial Sequence
  Description of Combined DNA/RNA molecule: Synthetic oligonucleotide
  Description of Artificial Sequence: Synthetic oligonucleotide
ugccaaguggucccaggcutt

SEQ ID NO: 445 - DNA, 21 bp, Artificial Sequence
  Description of Combined DNA/RNA molecule: Synthetic oligonucleotide
  Description of Artificial Sequence: Synthetic oligonucleotide
agccugggaccacuuggcatt

SEQ ID NO: 446 - RNA, 21 nt, Artificial Sequence
  Description of Artificial Sequence: Synthetic oligonucleotide
gccaaguggucccaggcugca

SEQ ID NO: 447 - RNA, 23 nt, Artificial Sequence
  Description of Artificial Sequence: Synthetic oligonucleotide
ugcagccugggaccacuuggcau

SEQ ID NO: 448 - DNA, 21 bp, Artificial Sequence
  Description of Combined DNA/RNA molecule: Synthetic oligonucleotide
  Description of Artificial Sequence: Synthetic oligonucleotide
gccaaguggucccaggcugtt

SEQ ID NO: 449 - DNA, 21 bp, Artificial Sequence
  Description of Combined DNA/RNA molecule: Synthetic oligonucleotide
  Description of Artificial Sequence: Synthetic oligonucleotide
cagccugggaccacuuggctt

SEQ ID NO: 450 - RNA, 21 nt, Artificial Sequence
  Description of Artificial Sequence: Synthetic oligonucleotide
ccaaguggucccaggcugcac

SEQ ID NO: 451 - RNA, 23 nt, Artificial Sequence
  Description of Artificial Sequence: Synthetic oligonucleotide
gugcagccugggaccacuuggca

SEQ ID NO: 452 - DNA, 21 bp, Artificial Sequence
  Description of Combined DNA/RNA molecule: Synthetic oligonucleotide
  Description of Artificial Sequence: Synthetic oligonucleotide
ccaaguggucccaggcugctt

SEQ ID NO: 453 - DNA, 21 bp, Artificial Sequence
  Description of Combined DNA/RNA molecule: Synthetic oligonucleotide
  Description of Artificial Sequence: Synthetic oligonucleotide
gcagccugggaccacuuggtt

SEQ ID NO: 454 - RNA, 21 nt, Artificial Sequence
  Description of Artificial Sequence: Synthetic oligonucleotide
caaguggucccaggcugcacc

SEQ ID NO: 455 - RNA, 23 nt, Artificial Sequence
  Description of Artificial Sequence: Synthetic oligonucleotide
ggugcagccugggaccacuuggc

SEQ ID NO: 456 - DNA, 21 bp, Artificial Sequence
  Description of Combined DNA/RNA molecule: Synthetic oligonucleotide
  Description of Artificial Sequence: Synthetic oligonucleotide
caaguggucccaggcugcatt

SEQ ID NO: 457 - DNA, 21 bp, Artificial Sequence
  Description of Combined DNA/RNA molecule: Synthetic oligonucleotide
  Description of Artificial Sequence: Synthetic oligonucleotide
ugcagccugggaccacuugtt

SEQ ID NO: 458 - RNA, 21 nt, Artificial Sequence
  Description of Artificial Sequence: Synthetic oligonucleotide
aaguggucccaggcugcaccc

SEQ ID NO: 459 - RNA, 23 nt, Artificial Sequence
  Description of Artificial Sequence: Synthetic oligonucleotide
gggugcagccugggaccacuugg

SEQ ID NO: 460 - DNA, 21 bp, Artificial Sequence
  Description of Combined DNA/RNA molecule: Synthetic oligonucleotide
  Description of Artificial Sequence: Synthetic oligonucleotide
aaguggucccaggcugcactt

SEQ ID NO: 461 - DNA, 21 bp, Artificial Sequence
  Description of Combined DNA/RNA molecule: Synthetic oligonucleotide
  Description of Artificial Sequence: Synthetic oligonucleotide
gugcagccugggaccacuutt

SEQ ID NO: 462 - RNA, 21 nt, Artificial Sequence
  Description of Artificial Sequence: Synthetic oligonucleotide
aguggucccaggcugcaccca

SEQ ID NO: 463 - RNA, 23 nt, Artificial Sequence
  Description of Artificial Sequence: Synthetic oligonucleotide
ugggugcagccugggaccacuug

SEQ ID NO: 464 - DNA, 21 bp, Artificial Sequence
  Description of Combined DNA/RNA molecule: Synthetic oligonucleotide
  Description of Artificial Sequence: Synthetic oligonucleotide
aguggucccaggcugcacctt

SEQ ID NO: 465 - DNA, 21 bp, Artificial Sequence
  Description of Combined DNA/RNA molecule: Synthetic oligonucleotide
  Description of Artificial Sequence: Synthetic oligonucleotide
ggugcagccugggaccacutt

SEQ ID NO: 466 - DNA, 21 bp, Artificial Sequence
  Description of Combined DNA/RNA molecule: Synthetic oligonucleotide
  Description of Artificial Sequence: Synthetic oligonucleotide
guggucccaggcugcaccctt

SEQ ID NO: 467 - DNA, 21 bp, Artificial Sequence
  Description of Combined DNA/RNA molecule: Synthetic oligonucleotide
  Description of Artificial Sequence: Synthetic oligonucleotide
gggugcagccugggaccactt

SEQ ID NO: 468 - DNA, 21 bp, Artificial Sequence
  Description of Combined DNA/RNA molecule: Synthetic oligonucleotide
  Description of Artificial Sequence: Synthetic oligonucleotide
ggcagaaucaucacgaagutt

SEQ ID NO: 469 - DNA, 21 bp, Artificial Sequence
  Description of Combined DNA/RNA molecule: Synthetic oligonucleotide
  Description of Artificial Sequence: Synthetic oligonucleotide
acuucgugaugauucugcctt

SEQ ID NO: 470 - DNA, 21 bp, Artificial Sequence
  Description of Combined DNA/RNA molecule: Synthetic oligonucleotide
  Description of Artificial Sequence: Synthetic oligonucleotide
gcagaaucaucacgaagugtt

SEQ ID NO: 471 - DNA, 21 bp, Artificial Sequence
  Description of Combined DNA/RNA molecule: Synthetic oligonucleotide
  Description of Artificial Sequence: Synthetic oligonucleotide
cacuucgugaugauucugctt

SEQ ID NO: 472 - DNA, 21 bp, Artificial Sequence
  Description of Combined DNA/RNA molecule: Synthetic oligonucleotide
  Description of Artificial Sequence: Synthetic oligonucleotide
cagaaucaucacgaaguggtt

SEQ ID NO: 473 - DNA, 21 bp, Artificial Sequence
  Description of Combined DNA/RNA molecule: Synthetic oligonucleotide
  Description of Artificial Sequence: Synthetic oligonucleotide
ccacuucgugaugauucugtt

SEQ ID NO: 474 - RNA, 21 nt, Artificial Sequence
  Description of Artificial Sequence: Synthetic oligonucleotide
agaaucaucacgaagugguga

SEQ ID NO: 475 - RNA, 23 nt, Artificial Sequence
  Description of Artificial Sequence: Synthetic oligonucleotide
ucaccacuucgugaugauucugc

SEQ ID NO: 476 - DNA, 21 bp, Artificial Sequence
  Description of Combined DNA/RNA molecule: Synthetic oligonucleotide
  Description of Artificial Sequence: Synthetic oligonucleotide
agaaucaucacgaaguggutt

SEQ ID NO: 477 - DNA, 21 bp, Artificial Sequence
  Description of Combined DNA/RNA molecule: Synthetic oligonucleotide
  Description of Artificial Sequence: Synthetic oligonucleotide
accacuucgugaugauucutt

SEQ ID NO: 478 - DNA, 21 bp, Artificial Sequence
  Description of Combined DNA/RNA molecule: Synthetic oligonucleotide
  Description of Artificial Sequence: Synthetic oligonucleotide
gaaucaucacgaaguggugtt

SEQ ID NO: 479 - DNA, 21 bp, Artificial Sequence
  Description of Combined DNA/RNA molecule: Synthetic oligonucleotide
  Description of Artificial Sequence: Synthetic oligonucleotide
caccacuucgugaugauuctt

SEQ ID NO: 480 - DNA, 21 bp, Artificial Sequence
  Description of Combined DNA/RNA molecule: Synthetic oligonucleotide
  Description of Artificial Sequence: Synthetic oligonucleotide
aaucaucacgaaguggugatt

SEQ ID NO: 481 - DNA, 21 bp, Artificial Sequence
  Description of Combined DNA/RNA molecule: Synthetic oligonucleotide
  Description of Artificial Sequence: Synthetic oligonucleotide
ucaccacuucgugaugauutt

SEQ ID NO: 482 - DNA, 21 bp, Artificial Sequence
  Description of Combined DNA/RNA molecule: Synthetic oligonucleotide
  Description of Artificial Sequence: Synthetic oligonucleotide
aucaucacgaaguggugaatt

SEQ ID NO: 483 - DNA, 21 bp, Artificial Sequence
  Description of Combined DNA/RNA molecule: Synthetic oligonucleotide
  Description of Artificial Sequence: Synthetic oligonucleotide
uucaccacuucgugaugautt

SEQ ID NO: 484 - RNA, 21 nt, Artificial Sequence
  Description of Artificial Sequence: Synthetic oligonucleotide
gaaguggugaaguucauggau

SEQ ID NO: 485 - RNA, 23 nt, Artificial Sequence
  Description of Artificial Sequence: Synthetic oligonucleotide
auccaugaacuucaccacuucgu

SEQ ID NO: 486 - RNA, 21 nt, Artificial Sequence
  Description of Artificial Sequence: Synthetic oligonucleotide
gaaguucauggaugucuauca

SEQ ID NO: 487 - RNA, 23 nt, Artificial Sequence
  Description of Artificial Sequence: Synthetic oligonucleotide
ugauagacauccaugaacuucac

SEQ ID NO: 488 - DNA, 21 bp, Artificial Sequence
  Description of Combined DNA/RNA molecule: Synthetic oligonucleotide
  Description of Artificial Sequence: Synthetic oligonucleotide
uggaugucuaucagcgcagtt

SEQ ID NO: 489 - DNA, 21 bp, Artificial Sequence
  Description of Combined DNA/RNA molecule: Synthetic oligonucleotide
  Description of Artificial Sequence: Synthetic oligonucleotide
cugcgcugauagacauccatt

SEQ ID NO: 490 - RNA, 21 nt, Artificial Sequence
  Description of Artificial Sequence: Synthetic oligonucleotide
ggaugucuaucagcgcagcua

SEQ ID NO: 491 - RNA, 23 nt, Artificial Sequence
  Description of Artificial Sequence: Synthetic oligonucleotide
uagcugcgcugauagacauccau

SEQ ID NO: 492 - DNA, 21 bp, Artificial Sequence
  Description of Combined DNA/RNA molecule: Synthetic oligonucleotide
  Description of Artificial Sequence: Synthetic oligonucleotide
ggaugucuaucagcgcagctt

SEQ ID NO: 493 - DNA, 21 bp, Artificial Sequence
  Description of Combined DNA/RNA molecule: Synthetic oligonucleotide
  Description of Artificial Sequence: Synthetic oligonucleotide
gcugcgcugauagacaucctt

SEQ ID NO: 494 - DNA, 21 bp, Artificial Sequence
  Description of Combined DNA/RNA molecule: Synthetic oligonucleotide
  Description of Artificial Sequence: Synthetic oligonucleotide
gaugucuaucagcgcagcutt

SEQ ID NO: 495 - DNA, 21 bp, Artificial Sequence
  Description of Combined DNA/RNA molecule: Synthetic oligonucleotide
  Description of Artificial Sequence: Synthetic oligonucleotide
agcugcgcugauagacauctt

SEQ ID NO: 496 - DNA, 21 bp, Artificial Sequence
  Description of Combined DNA/RNA molecule: Synthetic oligonucleotide
  Description of Artificial Sequence: Synthetic oligonucleotide
augucuaucagcgcagcuatt

SEQ ID NO: 497 - DNA, 21 bp, Artificial Sequence
  Description of Combined DNA/RNA molecule: Synthetic oligonucleotide
  Description of Artificial Sequence: Synthetic oligonucleotide
uagcugcgcugauagacautt

SEQ ID NO: 498 - DNA, 21 bp, Artificial Sequence
  Description of Combined DNA/RNA molecule: Synthetic oligonucleotide
  Description of Artificial Sequence: Synthetic oligonucleotide
ugucuaucagcgcagcuactt

SEQ ID NO: 499 - DNA, 21 bp, Artificial Sequence
  Description of Combined DNA/RNA molecule: Synthetic oligonucleotide
  Description of Artificial Sequence: Synthetic oligonucleotide
guagcugcgcugauagacatt

SEQ ID NO: 500 - RNA, 21 nt, Artificial Sequence
  Description of Artificial Sequence: Synthetic oligonucleotide
gucuaucagcgcagcuacugc

SEQ ID NO: 501 - RNA, 23 nt, Artificial Sequence
  Description of Artificial Sequence: Synthetic oligonucleotide
gcaguagcugcgcugauagacau

SEQ ID NO: 502 - DNA, 21 bp, Artificial Sequence
  Description of Combined DNA/RNA molecule: Synthetic oligonucleotide
  Description of Artificial Sequence: Synthetic oligonucleotide
gucuaucagcgcagcuacutt

SEQ ID NO: 503 - DNA, 21 bp, Artificial Sequence
  Description of Combined DNA/RNA molecule: Synthetic oligonucleotide
  Description of Artificial Sequence: Synthetic oligonucleotide
aguagcugcgcugauagactt

SEQ ID NO: 504 - DNA, 21 bp, Artificial Sequence
  Description of Combined DNA/RNA molecule: Synthetic oligonucleotide
  Description of Artificial Sequence: Synthetic oligonucleotide
ucuaucagcgcagcuacugtt

SEQ ID NO: 505 - DNA, 21 bp, Artificial Sequence
  Description of Combined DNA/RNA molecule: Synthetic oligonucleotide
  Description of Artificial Sequence: Synthetic oligonucleotide
caguagcugcgcugauagatt

SEQ ID NO: 506 - RNA, 21 nt, Artificial Sequence
  Description of Artificial Sequence: Synthetic oligonucleotide
gcagcuacugccauccaaucg

SEQ ID NO: 507 - RNA, 23 nt, Artificial Sequence
  Description of Artificial Sequence: Synthetic oligonucleotide
cgauuggauggcaguagcugcgc

SEQ ID NO: 508 - RNA, 21 nt, Artificial Sequence
  Description of Artificial Sequence: Synthetic oligonucleotide
agcuacugccauccaaucgag

SEQ ID NO: 509 - RNA, 23 nt, Artificial Sequence
  Description of Artificial Sequence: Synthetic oligonucleotide
cucgauuggauggcaguagcugc

SEQ ID NO: 510 - DNA, 21 bp, Artificial Sequence
  Description of Combined DNA/RNA molecule: Synthetic oligonucleotide
  Description of Artificial Sequence: Synthetic oligonucleotide
uacugccauccaaucgagatt

SEQ ID NO: 511 - DNA, 21 bp, Artificial Sequence
  Description of Combined DNA/RNA molecule: Synthetic oligonucleotide
  Description of Artificial Sequence: Synthetic oligonucleotide
ucucgauuggauggcaguatt

SEQ ID NO: 512 - DNA, 21 bp, Artificial Sequence
  Description of Combined DNA/RNA molecule: Synthetic oligonucleotide
  Description of Artificial Sequence: Synthetic oligonucleotide
acugccauccaaucgagactt

SEQ ID NO: 513 - DNA, 21 bp, Artificial Sequence
  Description of Combined DNA/RNA molecule: Synthetic oligonucleotide
  Description of Artificial Sequence: Synthetic oligonucleotide
gucucgauuggauggcagutt

SEQ ID NO: 514 - DNA, 21 bp, Artificial Sequence
  Description of Combined DNA/RNA molecule: Synthetic oligonucleotide
  Description of Artificial Sequence: Synthetic oligonucleotide
cugccauccaaucgagacctt

SEQ ID NO: 515 - DNA, 21 bp, Artificial Sequence
  Description of Combined DNA/RNA molecule: Synthetic oligonucleotide
  Description of Artificial Sequence: Synthetic oligonucleotide
ggucucgauuggauggcagtt

SEQ ID NO: 516 - DNA, 21 bp, Artificial Sequence
  Description of Combined DNA/RNA molecule: Synthetic oligonucleotide
  Description of Artificial Sequence: Synthetic oligonucleotide
ugccauccaaucgagaccctt

SEQ ID NO: 517 - DNA, 21 bp, Artificial Sequence
  Description of Combined DNA/RNA molecule: Synthetic oligonucleotide
  Description of Artificial Sequence: Synthetic oligonucleotide
gggucucgauuggauggcatt

SEQ ID NO: 518 - RNA, 21 nt, Artificial Sequence
  Description of Artificial Sequence: Synthetic oligonucleotide
gacccugguggacaucuucca

SEQ ID NO: 519 - RNA, 23 nt, Artificial Sequence
  Description of Artificial Sequence: Synthetic oligonucleotide
uggaagauguccaccagggucuc

SEQ ID NO: 520 - DNA, 21 bp, Artificial Sequence
  Description of Combined DNA/RNA molecule: Synthetic oligonucleotide
  Description of Artificial Sequence: Synthetic oligonucleotide
gacccugguggacaucuuctt

SEQ ID NO: 521 - DNA, 21 bp, Artificial Sequence
  Description of Combined DNA/RNA molecule: Synthetic oligonucleotide
  Description of Artificial Sequence: Synthetic oligonucleotide
gaagauguccaccaggguctt

SEQ ID NO: 522 - RNA, 21 nt, Artificial Sequence
  Description of Artificial Sequence: Synthetic oligonucleotide
acccugguggacaucuuccag

SEQ ID NO: 523 - RNA, 23 nt, Artificial Sequence
  Description of Artificial Sequence: Synthetic oligonucleotide
cuggaagauguccaccagggucu

SEQ ID NO: 524 - DNA, 21 bp, Artificial Sequence
  Description of Combined DNA/RNA molecule: Synthetic oligonucleotide
  Description of Artificial Sequence: Synthetic oligonucleotide
acccugguggacaucuucctt

SEQ ID NO: 525 - DNA, 21 bp, Artificial Sequence
  Description of Combined DNA/RNA molecule: Synthetic oligonucleotide
  Description of Artificial Sequence: Synthetic oligonucleotide
ggaagauguccaccagggutt

SEQ ID NO: 526 - RNA, 21 nt, Artificial Sequence
  Description of Artificial Sequence: Synthetic oligonucleotide
cccugguggacaucuuccagg

SEQ ID NO: 527 - RNA, 23 nt, Artificial Sequence
  Description of Artificial Sequence: Synthetic oligonucleotide
ccuggaagauguccaccaggguc

SEQ ID NO: 528 - DNA, 21 bp, Artificial Sequence
  Description of Combined DNA/RNA molecule: Synthetic oligonucleotide
  Description of Artificial Sequence: Synthetic oligonucleotide
cccugguggacaucuuccatt

SEQ ID NO: 529 - DNA, 21 bp, Artificial Sequence
  Description of Combined DNA/RNA molecule: Synthetic oligonucleotide
  Description of Artificial Sequence: Synthetic oligonucleotide
uggaagauguccaccagggtt

SEQ ID NO: 530 - RNA, 21 nt, Artificial Sequence
  Description of Artificial Sequence: Synthetic oligonucleotide
ccugguggacaucuuccagga

SEQ ID NO: 531 - RNA, 23 nt, Artificial Sequence
  Description of Artificial Sequence: Synthetic oligonucleotide
uccuggaagauguccaccagggu

SEQ ID NO: 532 - DNA, 21 bp, Artificial Sequence
  Description of Combined DNA/RNA molecule: Synthetic oligonucleotide
  Description of Artificial Sequence: Synthetic oligonucleotide
ccugguggacaucuuccagtt

SEQ ID NO: 533 - DNA, 21 bp, Artificial Sequence
  Description of Combined DNA/RNA molecule: Synthetic oligonucleotide
  Description of Artificial Sequence: Synthetic oligonucleotide
cuggaagauguccaccaggtt

SEQ ID NO: 534 - RNA, 21 nt, Artificial Sequence
  Description of Artificial Sequence: Synthetic oligonucleotide
cugguggacaucuuccaggag

SEQ ID NO: 535 - RNA, 23 nt, Artificial Sequence
  Description of Artificial Sequence: Synthetic oligonucleotide
cuccuggaagauguccaccaggg

SEQ ID NO: 536 - DNA, 21 bp, Artificial Sequence
  Description of Combined DNA/RNA molecule: Synthetic oligonucleotide
  Description of Artificial Sequence: Synthetic oligonucleotide
cugguggacaucuuccaggtt

SEQ ID NO: 537 - DNA, 21 bp, Artificial Sequence
  Description of Combined DNA/RNA molecule: Synthetic oligonucleotide
  Description of Artificial Sequence: Synthetic oligonucleotide
ccuggaagauguccaccagtt

SEQ ID NO: 538 - RNA, 21 nt, Artificial Sequence
  Description of Artificial Sequence: Synthetic oligonucleotide
ugguggacaucuuccaggagu

SEQ ID NO: 539 - RNA, 23 nt, Artificial Sequence
  Description of Artificial Sequence: Synthetic oligonucleotide
acuccuggaagauguccaccagg

SEQ ID NO: 540 - DNA, 21 bp, Artificial Sequence
  Description of Combined DNA/RNA molecule: Synthetic oligonucleotide
  Description of Artificial Sequence: Synthetic oligonucleotide
ugguggacaucuuccaggatt

SEQ ID NO: 541 - DNA, 21 bp, Artificial Sequence
  Description of Combined DNA/RNA molecule: Synthetic oligonucleotide
  Description of Artificial Sequence: Synthetic oligonucleotide
uccuggaagauguccaccatt

SEQ ID NO: 542 - RNA, 21 nt, Artificial Sequence
  Description of Artificial Sequence: Synthetic oligonucleotide
gguggacaucuuccaggagua

SEQ ID NO: 543 - RNA, 23 nt, Artificial Sequence
  Description of Artificial Sequence: Synthetic oligonucleotide
uacuccuggaagauguccaccag

SEQ ID NO: 544 - DNA, 21 bp, Artificial Sequence
  Description of Combined DNA/RNA molecule: Synthetic oligonucleotide
  Description of Artificial Sequence: Synthetic oligonucleotide
gguggacaucuuccaggagtt

SEQ ID NO: 545 - DNA, 21 bp, Artificial Sequence
  Description of Combined DNA/RNA molecule: Synthetic oligonucleotide
  Description of Artificial Sequence: Synthetic oligonucleotide
cuccuggaagauguccacctt

SEQ ID NO: 546 - RNA, 21 nt, Artificial Sequence
  Description of Artificial Sequence: Synthetic oligonucleotide
ggacaucuuccaggaguaccc

SEQ ID NO: 547 - RNA, 21 nt, Artificial Sequence
  Description of Artificial Sequence: Synthetic oligonucleotide
ggguacuccuggaagaugucc

SEQ ID NO: 548 - RNA, 21 nt, Artificial Sequence
  Description of Artificial Sequence: Synthetic oligonucleotide
ggacaucuuccaggaguaccc

SEQ ID NO: 549 - RNA, 21 nt, Artificial Sequence
  Description of Artificial Sequence: Synthetic oligonucleotide
ggguacuccuggaagaugucc

SEQ ID NO: 550 - DNA, 21 bp, Artificial Sequence
  Description of Combined DNA/RNA molecule: Synthetic oligonucleotide
  Description of Artificial Sequence: Synthetic oligonucleotide
ggacaucuuccaggaguactt

SEQ ID NO: 551 - DNA, 21 bp, Artificial Sequence
  Description of Combined DNA/RNA molecule: Synthetic oligonucleotide
  Description of Artificial Sequence: Synthetic oligonucleotide
guacuccuggaagaugucctt

SEQ ID NO: 552 - RNA, 19 nt, Artificial Sequence
  Description of Artificial Sequence: Synthetic oligonucleotide
ggacaucuuccaggaguac

SEQ ID NO: 553 - RNA, 19 nt, Artificial Sequence
  Description of Artificial Sequence: Synthetic oligonucleotide
guacuccuggaagaugucc

SEQ ID NO: 554 - RNA, 21 nt, Artificial Sequence
  Description of Artificial Sequence: Synthetic oligonucleotide
aucuuccaggaguacccugau

SEQ ID NO: 555 - RNA, 23 nt, Artificial Sequence
  Description of Artificial Sequence: Synthetic oligonucleotide
aucaggguacuccuggaagaugu

SEQ ID NO: 556 - DNA, 21 bp, Artificial Sequence
  Description of Combined DNA/RNA molecule: Synthetic oligonucleotide
  Description of Artificial Sequence: Synthetic oligonucleotide
uacccugaugagaucgagutt

SEQ ID NO: 557 - DNA, 21 bp, Artificial Sequence
  Description of Combined DNA/RNA molecule: Synthetic oligonucleotide
  Description of Artificial Sequence: Synthetic oligonucleotide
acucgaucucaucaggguatt

SEQ ID NO: 558 - RNA, 21 nt, Artificial Sequence
  Description of Artificial Sequence: Synthetic oligonucleotide
acccugaugagaucgaguaca

SEQ ID NO: 559 - RNA, 23 nt, Artificial Sequence
  Description of Artificial Sequence: Synthetic oligonucleotide
uguacucgaucucaucaggguac

SEQ ID NO: 560 - DNA, 21 bp, Artificial Sequence
  Description of Combined DNA/RNA molecule: Synthetic oligonucleotide
  Description of Artificial Sequence: Synthetic oligonucleotide
acccugaugagaucgaguatt

SEQ ID NO: 561 - DNA, 21 bp, Artificial Sequence
  Description of Combined DNA/RNA molecule: Synthetic oligonucleotide
  Description of Artificial Sequence: Synthetic oligonucleotide
uacucgaucucaucagggutt

SEQ ID NO: 562 - DNA, 21 bp, Artificial Sequence
  Description of Combined DNA/RNA molecule: Synthetic oligonucleotide
  Description of Artificial Sequence: Synthetic oligonucleotide
uacaucuucaagccauccutt

SEQ ID NO: 563 - DNA, 21 bp, Artificial Sequence
  Description of Combined DNA/RNA molecule: Synthetic oligonucleotide
  Description of Artificial Sequence: Synthetic oligonucleotide
aggauggcuugaagauguatt

SEQ ID NO: 564 - RNA, 21 nt, Artificial Sequence
  Description of Artificial Sequence: Synthetic oligonucleotide
aaugacgagggccuggagugu

SEQ ID NO: 565 - RNA, 23 nt, Artificial Sequence
  Description of Artificial Sequence: Synthetic oligonucleotide
acacuccaggcccucgucauugc

SEQ ID NO: 566 - RNA, 21 nt, Artificial Sequence
  Description of Artificial Sequence: Synthetic oligonucleotide
gacgagggccuggagugugug

SEQ ID NO: 567 - RNA, 23 nt, Artificial Sequence
  Description of Artificial Sequence: Synthetic oligonucleotide
cacacacuccaggcccucgucau

SEQ ID NO: 568 - RNA, 21 nt, Artificial Sequence
  Description of Artificial Sequence: Synthetic oligonucleotide
gugugcccacugaggagucca

SEQ ID NO: 569 - RNA, 23 nt, Artificial Sequence
  Description of Artificial Sequence: Synthetic oligonucleotide
uggacuccucagugggcacacac

SEQ ID NO: 570 - RNA, 21 nt, Artificial Sequence
  Description of Artificial Sequence: Synthetic oligonucleotide
gugcccacugaggaguccaac

SEQ ID NO: 571 - RNA, 23 nt, Artificial Sequence
  Description of Artificial Sequence: Synthetic oligonucleotide
guuggacuccucagugggcacac

SEQ ID NO: 572 - RNA, 21 nt, Artificial Sequence
  Description of Artificial Sequence: Synthetic oligonucleotide
gcccacugaggaguccaacau

SEQ ID NO: 573 - RNA, 23 nt, Artificial Sequence
  Description of Artificial Sequence: Synthetic oligonucleotide
auguuggacuccucagugggcac

SEQ ID NO: 574 - DNA, 21 bp, Artificial Sequence
  Description of Combined DNA/RNA molecule: Synthetic oligonucleotide
  Description of Artificial Sequence: Synthetic oligonucleotide
ugaggaguccaacaucacctt

SEQ ID NO: 575 - DNA, 21 bp, Artificial Sequence
  Description of Combined DNA/RNA molecule: Synthetic oligonucleotide
  Description of Artificial Sequence: Synthetic oligonucleotide
ggugauguuggacuccucatt

SEQ ID NO: 576 - RNA, 21 nt, Artificial Sequence
  Description of Artificial Sequence: Synthetic oligonucleotide
aucaccaugcagauuaugcgg

SEQ ID NO: 577 - RNA, 23 nt, Artificial Sequence
  Description of Artificial Sequence: Synthetic oligonucleotide
ccgcauaaucugcauggugaugu

SEQ ID NO: 578 - DNA, 21 bp, Artificial Sequence
  Description of Combined DNA/RNA molecule: Synthetic oligonucleotide
  Description of Artificial Sequence: Synthetic oligonucleotide
accaugcagauuaugcggatt

SEQ ID NO: 579 - DNA, 21 bp, Artificial Sequence
  Description of Combined DNA/RNA molecule: Synthetic oligonucleotide
  Description of Artificial Sequence: Synthetic oligonucleotide
uccgcauaaucugcauggutt

SEQ ID NO: 580 - RNA, 21 nt, Artificial Sequence
  Description of Artificial Sequence: Synthetic oligonucleotide
gcagauuaugcggaucaaacc

SEQ ID NO: 581 - RNA, 23 nt, Artificial Sequence
  Description of Artificial Sequence: Synthetic oligonucleotide
gguuugauccgcauaaucugcau

SEQ ID NO: 582 - RNA, 21 nt, Artificial Sequence
  Description of Artificial Sequence: Synthetic oligonucleotide
agauuaugcggaucaaaccuc

SEQ ID NO: 583 - RNA, 23 nt, Artificial Sequence
  Description of Artificial Sequence: Synthetic oligonucleotide
gagguuugauccgcauaaucugc

SEQ ID NO: 584 - DNA, 21 bp, Artificial Sequence
  Description of Combined DNA/RNA molecule: Synthetic oligonucleotide
  Description of Artificial Sequence: Synthetic oligonucleotide
uuaugcggaucaaaccucatt

SEQ ID NO: 585 - DNA, 21 bp, Artificial Sequence
  Description of Combined DNA/RNA molecule: Synthetic oligonucleotide
  Description of Artificial Sequence: Synthetic oligonucleotide
ugagguuugauccgcauaatt

SEQ ID NO: 586 - DNA, 21 bp, Artificial Sequence
  Description of Combined DNA/RNA molecule: Synthetic oligonucleotide
  Description of Artificial Sequence: Synthetic oligonucleotide
uaugcggaucaaaccucactt

SEQ ID NO: 587 - DNA, 21 bp, Artificial Sequence
  Description of Combined DNA/RNA molecule: Synthetic oligonucleotide
  Description of Artificial Sequence: Synthetic oligonucleotide
gugagguuugauccgcauatt

SEQ ID NO: 588 - DNA, 21 bp, Artificial Sequence
  Description of Combined DNA/RNA molecule: Synthetic oligonucleotide
  Description of Artificial Sequence: Synthetic oligonucleotide
augcggaucaaaccucacctt

SEQ ID NO: 589 - DNA, 21 bp, Artificial Sequence
  Description of Combined DNA/RNA molecule: Synthetic oligonucleotide
  Description of Artificial Sequence: Synthetic oligonucleotide
ggugagguuugauccgcautt

SEQ ID NO: 590 - RNA, 21 nt, Artificial Sequence
  Description of Artificial Sequence: Synthetic oligonucleotide
gcggaucaaaccucaccaagg

SEQ ID NO: 591 - RNA, 23 nt, Artificial Sequence
  Description of Artificial Sequence: Synthetic oligonucleotide
ccuuggugagguuugauccgcau

SEQ ID NO: 592 - RNA, 19 nt, Artificial Sequence
  Description of Artificial Sequence: Synthetic oligonucleotide
gcggaucaaaccucaccaa

SEQ ID NO: 593 - RNA, 19 nt, Artificial Sequence
  Description of Artificial Sequence: Synthetic oligonucleotide
uuggugagguuugauccgc

SEQ ID NO: 594 - DNA, 21 bp, Artificial Sequence
  Description of Combined DNA/RNA molecule: Synthetic oligonucleotide
  Description of Artificial Sequence: Synthetic oligonucleotide
gcggaucaaaccucaccaatt

SEQ ID NO: 595 - DNA, 21 bp, Artificial Sequence
  Description of Combined DNA/RNA molecule: Synthetic oligonucleotide
  Description of Artificial Sequence: Synthetic oligonucleotide
uuggugagguuugauccgctt

SEQ ID NO: 596 - RNA, 19 nt, Artificial Sequence
  Description of Artificial Sequence: Synthetic oligonucleotide
gcggaucaaaccucaccaa

SEQ ID NO: 597 - RNA, 19 nt, Artificial Sequence
  Description of Artificial Sequence: Synthetic oligonucleotide
uuggugagguuugauccgc

SEQ ID NO: 598 - RNA, 21 nt, Artificial Sequence
  Description of Artificial Sequence: Synthetic oligonucleotide
ggaucaaaccucaccaaggcc

SEQ ID NO: 599 - RNA, 23 nt, Artificial Sequence
  Description of Artificial Sequence: Synthetic oligonucleotide
ggccuuggugagguuugauccgc

SEQ ID NO: 600 - RNA, 21 nt, Artificial Sequence
  Description of Artificial Sequence: Synthetic oligonucleotide
cagcacauaggagagaugagc

SEQ ID NO: 601 - RNA, 23 nt, Artificial Sequence
  Description of Artificial Sequence: Synthetic oligonucleotide
gcucaucucuccuaugugcuggc

SEQ ID NO: 602 - DNA, 21 bp, Artificial Sequence
  Description of Combined DNA/RNA molecule: Synthetic oligonucleotide
  Description of Artificial Sequence: Synthetic oligonucleotide
cagcacauaggagagaugatt

SEQ ID NO: 603 - DNA, 21 bp, Artificial Sequence
  Description of Combined DNA/RNA molecule: Synthetic oligonucleotide
  Description of Artificial Sequence: Synthetic oligonucleotide
ucaucucuccuaugugcugtt

SEQ ID NO: 604 - RNA, 21 nt, Artificial Sequence
  Description of Artificial Sequence: Synthetic oligonucleotide
agcacauaggagagaugagcu

SEQ ID NO: 605 - RNA, 23 nt, Artificial Sequence
  Description of Artificial Sequence: Synthetic oligonucleotide
agcucaucucuccuaugugcugg

SEQ ID NO: 606 - DNA, 21 bp, Artificial Sequence
  Description of Combined DNA/RNA molecule: Synthetic oligonucleotide
  Description of Artificial Sequence: Synthetic oligonucleotide
agcacauaggagagaugagtt

SEQ ID NO: 607 - DNA, 21 bp, Artificial Sequence
  Description of Combined DNA/RNA molecule: Synthetic oligonucleotide
  Description of Artificial Sequence: Synthetic oligonucleotide
cucaucucuccuaugugcutt

SEQ ID NO: 608 - RNA, 21 nt, Artificial Sequence
  Description of Artificial Sequence: Synthetic oligonucleotide
gcacauaggagagaugagcuu

SEQ ID NO: 609 - RNA, 23 nt, Artificial Sequence
  Description of Artificial Sequence: Synthetic oligonucleotide
aagcucaucucuccuaugugcug

SEQ ID NO: 610 - RNA, 21 nt, Artificial Sequence
  Description of Artificial Sequence: Synthetic oligonucleotide
gcacauaggagagaugagcuu

SEQ ID NO: 611 - RNA, 21 nt, Artificial Sequence
  Description of Artificial Sequence: Synthetic oligonucleotide
aagcucaucucuccuaugugc

SEQ ID NO: 612 - DNA, 21 bp, Artificial Sequence
  Description of Combined DNA/RNA molecule: Synthetic oligonucleotide
  Description of Artificial Sequence: Synthetic oligonucleotide
gcacauaggagagaugagctt

SEQ ID NO: 613 - DNA, 21 bp, Artificial Sequence
  Description of Combined DNA/RNA molecule: Synthetic oligonucleotide
  Description of Artificial Sequence: Synthetic oligonucleotide
gcucaucucuccuaugugctt

SEQ ID NO: 614 - RNA, 19 nt, Artificial Sequence
  Description of Artificial Sequence: Synthetic oligonucleotide
gcacauaggagagaugagc

SEQ ID NO: 615 - RNA, 19 nt, Artificial Sequence
  Description of Artificial Sequence: Synthetic oligonucleotide
gcucaucucuccuaugugc

SEQ ID NO: 616 - RNA, 21 nt, Artificial Sequence
  Description of Artificial Sequence: Synthetic oligonucleotide
cacauaggagagaugagcuuc

SEQ ID NO: 617 - RNA, 23 nt, Artificial Sequence
  Description of Artificial Sequence: Synthetic oligonucleotide
gaagcucaucucuccuaugugcu

SEQ ID NO: 618 - DNA, 21 bp, Artificial Sequence
  Description of Combined DNA/RNA molecule: Synthetic oligonucleotide
  Description of Artificial Sequence: Synthetic oligonucleotide
cacauaggagagaugagcutt

SEQ ID NO: 619 - DNA, 21 bp, Artificial Sequence
  Description of Combined DNA/RNA molecule: Synthetic oligonucleotide
  Description of Artificial Sequence: Synthetic oligonucleotide
agcucaucucuccuaugugtt

SEQ ID NO: 620 - RNA, 21 nt, Artificial Sequence
  Description of Artificial Sequence: Synthetic oligonucleotide
cauaggagagaugagcuuccu

SEQ ID NO: 621 - RNA, 23 nt, Artificial Sequence
  Description of Artificial Sequence: Synthetic oligonucleotide
aggaagcucaucucuccuaugug

SEQ ID NO: 622 - DNA, 21 bp, Artificial Sequence
  Description of Combined DNA/RNA molecule: Synthetic oligonucleotide
  Description of Artificial Sequence: Synthetic oligonucleotide
cauaggagagaugagcuuctt

SEQ ID NO: 623 - DNA, 21 bp, Artificial Sequence
  Description of Combined DNA/RNA molecule: Synthetic oligonucleotide
  Description of Artificial Sequence: Synthetic oligonucleotide
gaagcucaucucuccuaugtt

SEQ ID NO: 624 - RNA, 21 nt, Artificial Sequence
  Description of Artificial Sequence: Synthetic oligonucleotide
aggagagaugagcuuccuaca

SEQ ID NO: 625 - RNA, 23 nt, Artificial Sequence
  Description of Artificial Sequence: Synthetic oligonucleotide
uguaggaagcucaucucuccuau

SEQ ID NO: 626 - RNA, 21 nt, Artificial Sequence
  Description of Artificial Sequence: Synthetic oligonucleotide
agcacaacaaaugugaaugca

SEQ ID NO: 627 - RNA, 23 nt, Artificial Sequence
  Description of Artificial Sequence: Synthetic oligonucleotide
ugcauucacauuuguugugcugu

SEQ ID NO: 628 - RNA, 21 nt, Artificial Sequence
  Description of Artificial Sequence: Synthetic oligonucleotide
acaacaaaugugaaugcagac

SEQ ID NO: 629 - RNA, 23 nt, Artificial Sequence
  Description of Artificial Sequence: Synthetic oligonucleotide
gucugcauucacauuuguugugc

SEQ ID NO: 630 - DNA, 21 bp, Artificial Sequence
  Description of Combined DNA/RNA molecule: Synthetic oligonucleotide
  Description of Artificial Sequence: Synthetic oligonucleotide
augugaaugcagaccaaagtt

SEQ ID NO: 631 - DNA, 21 bp, Artificial Sequence
  Description of Combined DNA/RNA molecule: Synthetic oligonucleotide
  Description of Artificial Sequence: Synthetic oligonucleotide
cuuuggucugcauucacautt

SEQ ID NO: 632 - DNA, 21 bp, Artificial Sequence
  Description of Combined DNA/RNA molecule: Synthetic oligonucleotide
  Description of Artificial Sequence: Synthetic oligonucleotide
ugugaaugcagaccaaagatt

SEQ ID NO: 633 - DNA, 21 bp, Artificial Sequence
  Description of Combined DNA/RNA molecule: Synthetic oligonucleotide
  Description of Artificial Sequence: Synthetic oligonucleotide
ucuuuggucugcauucacatt

SEQ ID NO: 634 - RNA, 21 nt, Artificial Sequence
  Description of Artificial Sequence: Synthetic oligonucleotide
gugaaugcagaccaaagaaag

SEQ ID NO: 635 - RNA, 23 nt, Artificial Sequence
  Description of Artificial Sequence: Synthetic oligonucleotide
cuuucuuuggucugcauucacau

SEQ ID NO: 636 - RNA, 21 nt, Artificial Sequence
  Description of Artificial Sequence: Synthetic oligonucleotide
gugaaugcagaccaaagaaag

SEQ ID NO: 637 - RNA, 21 nt, Artificial Sequence
  Description of Artificial Sequence: Synthetic oligonucleotide
cuuucuuuggucugcauucac

SEQ ID NO: 638 - DNA, 21 bp, Artificial Sequence
  Description of Combined DNA/RNA molecule: Synthetic oligonucleotide
  Description of Artificial Sequence: Synthetic oligonucleotide
gugaaugcagaccaaagaatt

SEQ ID NO: 639 - DNA, 21 bp, Artificial Sequence
  Description of Combined DNA/RNA molecule: Synthetic oligonucleotide
  Description of Artificial Sequence: Synthetic oligonucleotide
uucuuuggucugcauucactt

SEQ ID NO: 640 - RNA, 19 nt, Artificial Sequence
  Description of Artificial Sequence: Synthetic oligonucleotide
gugaaugcagaccaaagaa

SEQ ID NO: 641 - RNA, 19 nt, Artificial Sequence
  Description of Artificial Sequence: Synthetic oligonucleotide
uucuuuggucugcauucac

SEQ ID NO: 642 - RNA, 21 nt, Artificial Sequence
  Description of Artificial Sequence: Synthetic oligonucleotide
gaaugcagaccaaagaaagau

SEQ ID NO: 643 - RNA, 23 nt, Artificial Sequence
  Description of Artificial Sequence: Synthetic oligonucleotide
aucuuucuuuggucugcauucac

SEQ ID NO: 644 - DNA, 21 bp, Artificial Sequence
  Description of Combined DNA/RNA molecule: Synthetic oligonucleotide
  Description of Artificial Sequence: Synthetic oligonucleotide
gaaugcagaccaaagaaagtt

SEQ ID NO: 645 - DNA, 21 bp, Artificial Sequence
  Description of Combined DNA/RNA molecule: Synthetic oligonucleotide
  Description of Artificial Sequence: Synthetic oligonucleotide
cuuucuuuggucugcauuctt

SEQ ID NO: 646 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  misc_feature (2)..(3): Phosphorothioate linkage
  misc_feature (18)..(19): Phosphorothioate linkage
  misc_feature (19)..(20): Phosphorothioate linkage
  misc_feature (20)..(21): Phosphorothioate linkage
gcggaucaaaccucaccaatt

SEQ ID NO: 647 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  misc_feature (2)..(3): Phosphorothioate linkage
  misc_feature (18)..(19): Phosphorothioate linkage
  misc_feature (19)..(20): Phosphorothioate linkage
  misc_feature (20)..(21): Phosphorothioate linkage
uuggugagguuugauccgctt

SEQ ID NO: 648 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  misc_feature (2)..(3): Phosphorothioate linkage
  misc_feature (14)..(15): Phosphorothioate linkage
  misc_feature (17)..(18): Phosphorothioate linkage
  misc_feature (18)..(19): Phosphorothioate linkage
  misc_feature (19)..(20): Phosphorothioate linkage
  misc_feature (20)..(21): Phosphorothioate linkage
gcggaucaaaccucaccaatt

SEQ ID NO: 649 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  misc_feature (19)..(20): Phosphorothioate linkage
  misc_feature (20)..(21): Phosphorothioate linkage
uuggugagguuugauccgctt

SEQ ID NO: 650 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  misc_feature (2)..(3): Phosphorothioate linkage
  misc_feature (14)..(15): Phosphorothioate linkage
  misc_feature (17)..(18): Phosphorothioate linkage
  misc_feature (18)..(19): Phosphorothioate linkage
  misc_feature (19)..(20): Phosphorothioate linkage
  misc_feature (20)..(21): Phosphorothioate linkage
gcggaucaaaccucaccaatt

SEQ ID NO: 651 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  misc_feature (2)..(3): Phosphorothioate linkage
  misc_feature (18)..(19): Phosphorothioate linkage
  misc_feature (19)..(20): Phosphorothioate linkage
  misc_feature (20)..(21): Phosphorothioate linkage
uuggugagguuugauccgctt

SEQ ID NO: 652 - RNA, 21 nt, Artificial Sequence
  Description of Artificial Sequence: Synthetic oligonucleotide
  misc_feature (1)..(2): Phosphorothioate linkage
  misc_feature (20)..(21): Phosphorothioate linkage
gcacauaggagagaugagcuu

SEQ ID NO: 653 - RNA, 23 nt, Artificial Sequence
  Description of Artificial Sequence: Synthetic oligonucleotide
  misc_feature (1)..(2): Phosphorothioate linkage
  misc_feature (22)..(23): Phosphorothioate linkage
aagcucaucucuccuaugugcug

SEQ ID NO: 654 - RNA, 22 nt, Artificial Sequence
  Description of Artificial Sequence: Synthetic oligonucleotide
  misc_feature (1)..(2): Phosphorothioate linkage
  modified_base (20)..(20): 2'O-Methyl-cytosine
  modified_base (21)..(21): 2'O-Methyl-uracil
  misc_feature (21)..(22): Phosphorothioate linkage
aagucaucucuccuaugugcug

SEQ ID NO: 655 - RNA, 22 nt, Artificial Sequence
  Description of Artificial Sequence: Synthetic oligonucleotide
  misc_feature (1)..(2): Phosphorothioate linkage
  modified_base (14)..(14): 2'O-Methyl-uracil
  modified_base (20)..(20): 2'O-Methyl-cytosine
  modified_base (21)..(21): 2'O-Methyl-uracil
  misc_feature (21)..(22): Phosphorothioate linkage
aagucaucucuccuaugugcug

SEQ ID NO: 656 - RNA, 23 nt, Artificial Sequence
  Description of Artificial Sequence: Synthetic oligonucleotide
  modified_base (6)..(6): 2'O-Methyl-cytosine
  modified_base (15)..(15): 2'O-Methyl-uracil
  modified_base (17)..(17): 2'O-Methyl-uracil
  modified_base (19)..(19): 2'O-Methyl-uracil
  modified_base (22)..(22): 2'O-Methyl-uracil
  misc_feature (22)..(23): Phosphorothioate linkage
aagcucaucucuccuaugugcug

SEQ ID NO: 657 - RNA, 23 nt, Artificial Sequence
  Description of Artificial Sequence: Synthetic oligonucleotide
  modified_base (6)..(6): 2'O-Methyl-cytosine
  modified_base (15)..(15): 2'O-Methyl-uracil
  modified_base (17)..(17): 2'O-Methyl-uracil
  modified_base (19)..(19): 2'O-Methyl-uracil
  modified_base (21)..(21): 2'O-Methyl-cytosine
  modified_base (22)..(22): 2'O-Methyl-uracil
  misc_feature (22)..(23): Phosphorothioate linkage
aagcucaucucuccuaugugcug

SEQ ID NO: 658 - RNA, 23 nt, Artificial Sequence
  Description of Artificial Sequence: Synthetic oligonucleotide
  modified_base (15)..(15): 2'O-Methyl-uracil
  modified_base (17)..(17): 2'O-Methyl-uracil
  modified_base (19)..(19): 2'O-Methyl-uracil
  modified_base (22)..(22): 2'O-Methyl-uracil
  misc_feature (22)..(23): Phosphorothioate linkage
aagcucaucucuccuaugugcug

SEQ ID NO: 659 - RNA, 21 nt, Artificial Sequence
  Description of Artificial Sequence: Synthetic oligonucleotide
  misc_feature (1)..(2): Phosphorothioate linkage
  modified_base (6)..(6): 2'O-Methyl-uracil
  misc_feature (20)..(21): Phosphorothioate linkage
gcacauaggagagaugagcuu

SEQ ID NO: 660 - RNA, 21 nt, Artificial Sequence
  Description of Artificial Sequence: Synthetic oligonucleotide
  modified_base (2)..(2): 2'O-Methyl-cytosine
  modified_base (4)..(4): 2'O-Methyl-cytosine
  modified_base (6)..(6): 2'O-Methyl-uracil
  modified_base (15)..(15): 2'O-Methyl-uracil
  modified_base (20)..(20): 2'O-Methyl-uracil
  misc_feature (20)..(21): Phosphorothioate linkage
gcacauaggagagaugagcuu

SEQ ID NO: 661 - RNA, 21 nt, Artificial Sequence
  Description of Artificial Sequence: Synthetic oligonucleotide
  modified_base (6)..(6): 2'O-Methyl-uracil
  modified_base (15)..(15): 2'O-Methyl-uracil
  modified_base (20)..(20): 2'O-Methyl-uracil
  misc_feature (20)..(21): Phosphorothioate linkage
gcacauaggagagaugagcuu

SEQ ID NO: 662 - RNA, 21 nt, Artificial Sequence
  Description of Artificial Sequence: Synthetic oligonucleotide
  misc_feature (1)..(2): Phosphorothioate linkage
  modified_base (6)..(6): 2'Fluoro-uracil
  misc_feature (20)..(21): Phosphorothioate linkage
gcacauaggagagaugagcuu

SEQ ID NO: 663 - RNA, 21 nt, Artificial Sequence
  Description of Artificial Sequence: Synthetic oligonucleotide
  modified_base (2)..(2): 2'Fluoro-cytosine
  modified_base (4)..(4): 2'Fluoro-cytosine
  modified_base (6)..(6): 2'Fluoro-uracil
  modified_base (15)..(15): 2'Fluoro-uracil
  modified_base (20)..(20): 2'Fluoro-uracil
  misc_feature (20)..(21): Phosphorothioate linkage
gcacauaggagagaugagcuu

SEQ ID NO: 664 - RNA, 21 nt, Artificial Sequence
  Description of Artificial Sequence: Synthetic oligonucleotide
  modified_base (2)..(2): 2'Fluoro-cytosine
  modified_base (4)..(4): 2'Fluoro-cytosine
  modified_base (6)..(6): 2'O-Methyl-uracil
  modified_base (15)..(15): 2'O-Methyl-uracil
  modified_base (20)..(20): 2'O-Methyl-uracil
  misc_feature (20)..(21): Phosphorothioate linkage
gcacauaggagagaugagcuu

SEQ ID NO: 665 - RNA, 21 nt, Artificial Sequence
  Description of Artificial Sequence: Synthetic oligonucleotide
  modified_base (2)..(2): 2'O-Methyl-cytosine
  modified_base (4)..(4): 2'O-Methyl-cytosine
  modified_base (6)..(6): 2'Fluoro-uracil
  modified_base (15)..(15): 2'Fluoro-uracil
  modified_base (20)..(20): 2'Fluoro-uracil
  misc_feature (20)..(21): Phosphorothioate linkage
gcacauaggagagaugagcuu

SEQ ID NO: 666 - RNA, 23 nt, Artificial Sequence
  Description of Artificial Sequence: Synthetic oligonucleotide
  modified_base (6)..(6): 2'Fluoro-cytosine
  modified_base (15)..(15): 2'Fluoro-uracil
  modified_base (17)..(17): 2'Fluoro-uracil
  modified_base (19)..(19): 2'Fluoro-uracil
  modified_base (22)..(22): 2'Fluoro-uracil
  misc_feature (22)..(23): Phosphorothioate linkage
aagcucaucucuccuaugugcug

SEQ ID NO: 667 - RNA, 23 nt, Artificial Sequence
  Description of Artificial Sequence: Synthetic oligonucleotide
  modified_base (6)..(6): 2'O-Methyl-cytosine
  modified_base (15)..(15): 2'Fluoro-uracil
  modified_base (17)..(17): 2'Fluoro-uracil
  modified_base (19)..(19): 2'Fluoro-uracil
  modified_base (22)..(22): 2'Fluoro-uracil
  misc_feature (22)..(23): Phosphorothioate linkage
aagcucaucucuccuaugugcug

SEQ ID NO: 668 - RNA, 23 nt, Artificial Sequence
  Description of Artificial Sequence: Synthetic oligonucleotide
  modified_base (6)..(6): 2'Fluoro-cytosine
  modified_base (15)..(15): 2'O-Methyl-uracil
  modified_base (17)..(17): 2'O-Methyl-uracil
  modified_base (19)..(19): 2'O-Methyl-uracil
  modified_base (22)..(22): 2'O-Methyl-uracil
  misc_feature (22)..(23): Phosphorothioate linkage
aagcucaucucuccuaugugcug

SEQ ID NO: 669 - RNA, 21 nt, Artificial Sequence
  Description of Artificial Sequence: Synthetic oligonucleotide
  misc_feature (1)..(2): Phosphorothioate linkage
  modified_base (2)..(2): 2'O-Methyl-cytosine
  modified_base (4)..(4): 2'O-Methyl-cytosine
  modified_base (6)..(6): 2'O-Methyl-uracil
  modified_base (15)..(15): 2'O-Methyl-uracil
  modified_base (20)..(20): 2'O-Methyl-uracil
  misc_feature (20)..(21): Phosphorothioate linkage
gcacauaggagagaugagcuu

SEQ ID NO: 670 - RNA, 23 nt, Artificial Sequence
  Description of Artificial Sequence: Synthetic oligonucleotide
  misc_feature (1)..(2): Phosphorothioate linkage
  modified_base (6)..(6): 2'Fluoro-cytosine
  modified_base (15)..(15): 2'Fluoro-uracil
  modified_base (17)..(17): 2'Fluoro-uracil
  modified_base (19)..(19): 2'Fluoro-uracil
  modified_base (22)..(22): 2'Fluoro-uracil
  misc_feature (22)..(23): Phosphorothioate linkage
aagcucaucucuccuaugugcug

SEQ ID NO: 671 - RNA, 21 nt, Artificial Sequence
  Description of Artificial Sequence: Synthetic oligonucleotide
  misc_feature (20)..(21): Phosphorothioate linkage
gcacauaggagagaugagcuu

SEQ ID NO: 672 - RNA, 23 nt, Artificial Sequence
  Description of Artificial Sequence: Synthetic oligonucleotide
  misc_feature (22)..(23): Phosphorothioate linkage
aagcucaucucuccuaugugcug

SEQ ID NO: 673 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  misc_feature (20)..(21): Phosphorothioate linkage
caaguggucccaggcugcatt

SEQ ID NO: 674 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  misc_feature (20)..(21): Phosphorothioate linkage
ugcagccugggaccacuugtt

SEQ ID NO: 675 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  misc_feature (20)..(21): Phosphorothioate linkage
ggacaucuuccaggaguactt

SEQ ID NO: 676 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  misc_feature (20)..(21): Phosphorothioate linkage
guacuccuggaagaugucctt

SEQ ID NO: 677 - DNA, 21 bp, Artificial Sequence
  Description of Combined DNA/RNA molecule: Synthetic oligonucleotide
  Description of Artificial Sequence: Synthetic oligonucleotide
  modified_base (1)..(2): 2'O-Methyl-cytosine
  modified_base (6)..(6): 2'O-Methyl-uracil
  modified_base (9)..(9): 2'O-Methyl-uracil
  modified_base (10)..(12): 2'O-Methyl-cytosine
  modified_base (16)..(16): 2'O-Methyl-cytosine
  modified_base (17)..(17): 2'O-Methyl-uracil
  modified_base (19)..(19): 2'O-Methyl-cytosine
  misc_feature (20)..(21): Phosphorothioate linkage
ccaaguggucccaggcugctt

SEQ ID NO: 678 - DNA, 21 bp, Artificial Sequence
  Description of Combined DNA/RNA molecule: Synthetic oligonucleotide
  Description of Artificial Sequence: Synthetic oligonucleotide
  modified_base (2)..(2): 2'Fluoro-cytosine
  modified_base (5)..(6): 2'Fluoro-cytosine
  modified_base (7)..(7): 2'Fluoro-uracil
  modified_base (12)..(13): 2'Fluoro-cytosine
  modified_base (15)..(15): 2'Fluoro-cytosine
  modified_base (16)..(17): 2'Fluoro-uracil
  misc_feature (20)..(21): Phosphorothioate linkage
gcagccugggaccacuuggtt

SEQ ID NO: 679 - DNA, 21 bp, Artificial Sequence
  Description of Combined DNA/RNA molecule: Synthetic oligonucleotide
  Description of Artificial Sequence: Synthetic oligonucleotide
  modified_base (2)..(2): 2'O-Methyl-cytosine
  modified_base (6)..(6): 2'O-Methyl-uracil
  modified_base (7)..(7): 2'O-Methyl-cytosine
  modified_base (11)..(12): 2'O-Methyl-cytosine
  modified_base (13)..(13): 2'O-Methyl-uracil
  modified_base (14)..(14): 2'O-Methyl-cytosine
  modified_base (16)..(17): 2'O-Methyl-cytosine
  misc_feature (20)..(21): Phosphorothioate linkage
gcggaucaaaccucaccaatt

SEQ ID NO: 680 - DNA, 21 bp, Artificial Sequence
  Description of Combined DNA/RNA molecule: Synthetic oligonucleotide
  Description of Artificial Sequence: Synthetic oligonucleotide
  modified_base (1)..(2): 2'Fluoro-uracil
  modified_base (5)..(5): 2'Fluoro-uracil
  modified_base (10)..(12): 2'Fluoro-uracil
  modified_base (15)..(15): 2'Fluoro-uracil
  modified_base (16)..(17): 2'Fluoro-cytosine
  modified_base (19)..(19): 2'Fluoro-cytosine
  misc_feature (20)..(21): Phosphorothioate linkage
uuggugagguuugauccgctt

SEQ ID NO: 681 - RNA, 21 nt, Artificial Sequence
  Description of Artificial Sequence: Synthetic oligonucleotide
  misc_feature (1)..(2): Phosphorothioate linkage
  misc_feature (20)..(21): Phosphorothioate linkage
gugaaugcagaccaaagaaag

SEQ ID NO: 682 - RNA, 23 nt, Artificial Sequence
  Description of Artificial Sequence: Synthetic oligonucleotide
  misc_feature (1)..(2): Phosphorothioate linkage
  misc_feature (22)..(23): Phosphorothioate linkage
cuuucuuuggucugcauucacau

SEQ ID NO: 683 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  misc_feature (2)..(3): Phosphorothioate linkage
  misc_feature (18)..(19): Phosphorothioate linkage
  misc_feature (19)..(20): Phosphorothioate linkage
  misc_feature (20)..(21): Phosphorothioate linkage
gcggaacaauccugaccaatt

SEQ ID NO: 684 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  misc_feature (2)..(3): Phosphorothioate linkage
  misc_feature (20)..(21): Phosphorothioate linkage
uuggucaggauuguuccgctt

SEQ ID NO: 685 - DNA, 21 bp, Artificial Sequence
  Description of Combined DNA/RNA molecule: Synthetic oligonucleotide
  Description of Artificial Sequence: Synthetic oligonucleotide
ccaccaugccaaguggucctt

SEQ ID NO: 686 - DNA, 21 bp, Artificial Sequence
  Description of Combined DNA/RNA molecule: Synthetic oligonucleotide
  Description of Artificial Sequence: Synthetic oligonucleotide
ggaccacuuggcaugguggtt

SEQ ID NO: 687 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 2'O-Methyl-cytosine
  misc_feature (2)..(3): Phosphorothioate linkage
  modified_base (4)..(4): 2'O-Methyl-cytosine
  modified_base (6)..(6): 2'O-Methyl-adenine
  modified_base (8)..(8): 2'O-Methyl-guanine
  modified_base (10)..(10): 2'O-Methyl-cytosine
  modified_base (12)..(12): 2'O-Methyl-adenine
  modified_base (14)..(14): 2'O-Methyl-uracil
  modified_base (16)..(16): 2'O-Methyl-guanine
  modified_base (18)..(18): 2'O-Methyl-cytosine
  misc_feature (18)..(19): Phosphorothioate linkage
  misc_feature (19)..(20): Phosphorothioate linkage
  misc_feature (20)..(21): Phosphorothioate linkage
ccaccaugccaaguggucctt

SEQ ID NO: 688 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 2'O-Methyl-guanine
  misc_feature (2)..(3): Phosphorothioate linkage
  modified_base (4)..(4): 2'O-Methyl-cytosine
  modified_base (6)..(6): 2'O-Methyl-adenine
  modified_base (8)..(8): 2'O-Methyl-uracil
  modified_base (10)..(10): 2'O-Methyl-guanine
  modified_base (12)..(12): 2'O-Methyl-cytosine
  modified_base (14)..(14): 2'O-Methyl-uracil
  modified_base (16)..(16): 2'O-Methyl-guanine
  modified_base (18)..(18): 2'O-Methyl-guanine
  misc_feature (18)..(19): Phosphorothioate linkage
  misc_feature (19)..(20): Phosphorothioate linkage
  misc_feature (20)..(21): Phosphorothioate linkage
ggaccacuuggcaugguggtt

SEQ ID NO: 689 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-cytosine
  misc_feature (1)..(2): Phosphorothioate linkage
  misc_feature (2)..(3): Phosphorothioate linkage
  modified_base (3)..(3): 2'O-Methyl-adenine
  modified_base (5)..(5): 2'O-Methyl-cytosine
  modified_base (7)..(7): 2'O-Methyl-uracil
  modified_base (9)..(9): 2'O-Methyl-cytosine
  modified_base (11)..(11): 2'O-Methyl-adenine
  modified_base (13)..(13): 2'O-Methyl-guanine
  modified_base (15)..(15): 2'O-Methyl-guanine
  modified_base (17)..(17): 2'O-Methyl-uracil
  misc_feature (18)..(19): Phosphorothioate linkage
  modified_base (19)..(19): 2'O-Methyl-cytosine
  misc_feature (19)..(20): Phosphorothioate linkage
  misc_feature (20)..(21): Phosphorothioate linkage
ccaccaugccaaguggucctt

SEQ ID NO: 690 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-guanine
  misc_feature (1)..(2): Phosphorothioate linkage
  misc_feature (2)..(3): Phosphorothioate linkage
  modified_base (3)..(3): 2'O-Methyl-adenine
  modified_base (5)..(5): 2'O-Methyl-cytosine
  modified_base (7)..(7): 2'O-Methyl-cytosine
  modified_base (9)..(9): 2'O-Methyl-uracil
  modified_base (11)..(11): 2'O-Methyl-guanine
  modified_base (13)..(13): 2'O-Methyl-adenine
  modified_base (15)..(15): 2'O-Methyl-guanine
  modified_base (17)..(17): 2'O-Methyl-uracil
  misc_feature (18)..(19): Phosphorothioate linkage
  modified_base (19)..(19): 2'O-Methyl-guanine
  misc_feature (19)..(20): Phosphorothioate linkage
  misc_feature (20)..(21): Phosphorothioate linkage
ggaccacuuggcaugguggtt

SEQ ID NO: 691 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-cytosine
  misc_feature (1)..(2): Phosphorothioate linkage
  modified_base (2)..(2): 2'O-Methyl-cytosine
  modified_base (4)..(5): 2'O-Methyl-cytosine
  modified_base (7)..(7): 2'O-Methyl-uracil
  modified_base (9)..(10): 2'O-Methyl-cytosine
  modified_base (14)..(14): 2'O-Methyl-uracil
  modified_base (17)..(17): 2'O-Methyl-uracil
  modified_base (18)..(19): 2'O-Methyl-cytosine
  misc_feature (20)..(21): Phosphorothioate linkage
ccaccaugccaaguggucctt

SEQ ID NO: 692 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (4)..(5): 2'O-Methyl-cytosine
  modified_base (7)..(7): 2'O-Methyl-cytosine
  modified_base (8)..(9): 2'O-Methyl-uracil
  modified_base (12)..(12): 2'O-Methyl-cytosine
  modified_base (14)..(14): 2'O-Methyl-uracil
  modified_base (17)..(17): 2'O-Methyl-uracil
  misc_feature (20)..(21): Phosphorothioate linkage
ggaccacuuggcaugguggtt

SEQ ID NO: 693 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 2'O-Methyl-cytosine
  modified_base (5)..(5): 2'O-Methyl-cytosine
  modified_base (7)..(7): 2'O-Methyl-uracil
  modified_base (10)..(10): 2'O-Methyl-cytosine
  modified_base (14)..(14): 2'O-Methyl-uracil
  misc_feature (20)..(21): Phosphorothioate linkage
ccaccaugccaaguggucctt

SEQ ID NO: 694 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (5)..(5): 2'O-Methyl-cytosine
  modified_base (9)..(9): 2'O-Methyl-uracil
  modified_base (12)..(12): 2'O-Methyl-cytosine
  modified_base (14)..(14): 2'O-Methyl-uracil
  modified_base (17)..(17): 2'O-Methyl-uracil
  misc_feature (20)..(21): Phosphorothioate linkage
ggaccacuuggcaugguggtt

SEQ ID NO: 695 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (4)..(5): 2'Fluoro-cytosine
  modified_base (7)..(7): 2'Fluoro-cytosine
  modified_base (8)..(9): 2'Fluoro-uracil
  modified_base (12)..(12): 2'Fluoro-cytosine
  modified_base (14)..(14): 2'Fluoro-uracil
  modified_base (17)..(17): 2'Fluoro-uracil
  misc_feature (20)..(21): Phosphorothioate linkage
ggaccacuuggcaugguggtt

SEQ ID NO: 696 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (5)..(5): 2'Fluoro-cytosine
  modified_base (9)..(9): 2'Fluoro-uracil
  modified_base (12)..(12): 2'Fluoro-cytosine
  modified_base (14)..(14): 2'Fluoro-uracil
  modified_base (17)..(17): 2'Fluoro-uracil
  misc_feature (20)..(21): Phosphorothioate linkage
ggaccacuuggcaugguggtt

SEQ ID NO: 697 - DNA, 21 bp, Artificial Sequence
  Description of Combined DNA/RNA molecule: Synthetic oligonucleotide
  Description of Artificial Sequence: Synthetic oligonucleotide
ccaaguggucccaggcugctt

SEQ ID NO: 698 - DNA, 21 bp, Artificial Sequence
  Description of Combined DNA/RNA molecule: Synthetic oligonucleotide
  Description of Artificial Sequence: Synthetic oligonucleotide
gcagccugggaccacuuggtt

SEQ ID NO: 699 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 2'O-Methyl-cytosine
  misc_feature (2)..(3): Phosphorothioate linkage
  modified_base (4)..(4): 2'O-Methyl-adenine
  modified_base (6)..(6): 2'O-Methyl-uracil
  modified_base (8)..(8): 2'O-Methyl-guanine
  modified_base (10)..(10): 2'O-Methyl-cytosine
  modified_base (12)..(12): 2'O-Methyl-cytosine
  modified_base (14)..(14): 2'O-Methyl-guanine
  modified_base (16)..(16): 2'O-Methyl-cytosine
  modified_base (18)..(18): 2'O-Methyl-guanine
  misc_feature (18)..(19): Phosphorothioate linkage
  misc_feature (19)..(20): Phosphorothioate linkage
  misc_feature (20)..(21): Phosphorothioate linkage
ccaaguggucccaggcugctt

SEQ ID NO: 700 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 2'O-Methyl-cytosine
  misc_feature (2)..(3): Phosphorothioate linkage
  modified_base (4)..(4): 2'O-Methyl-guanine
  modified_base (6)..(6): 2'O-Methyl-cytosine
  modified_base (8)..(8): 2'O-Methyl-guanine
  modified_base (10)..(10): 2'O-Methyl-guanine
  modified_base (12)..(12): 2'O-Methyl-cytosine
  modified_base (14)..(14): 2'O-Methyl-adenine
  modified_base (16)..(16): 2'O-Methyl-uracil
  modified_base (18)..(18): 2'O-Methyl-guanine
  misc_feature (18)..(19): Phosphorothioate linkage
  misc_feature (19)..(20): Phosphorothioate linkage
  misc_feature (20)..(21): Phosphorothioate linkage
gcagccugggaccacuuggtt

SEQ ID NO: 701 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-cytosine
  misc_feature (1)..(2): Phosphorothioate linkage
  misc_feature (2)..(3): Phosphorothioate linkage
  modified_base (3)..(3): 2'O-Methyl-adenine
  modified_base (5)..(5): 2'O-Methyl-guanine
  modified_base (7)..(7): 2'O-Methyl-guanine
  modified_base (9)..(9): 2'O-Methyl-uracil
  modified_base (11)..(11): 2'O-Methyl-cytosine
  modified_base (13)..(13): 2'O-Methyl-adenine
  modified_base (15)..(15): 2'O-Methyl-guanine
  modified_base (17)..(17): 2'O-Methyl-uracil
  misc_feature (18)..(19): Phosphorothioate linkage
  modified_base (19)..(19): 2'O-Methyl-cytosine
  misc_feature (19)..(20): Phosphorothioate linkage
  misc_feature (20)..(21): Phosphorothioate linkage
ccaaguggucccaggcugctt

SEQ ID NO: 702 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-guanine
  misc_feature (1)..(2): Phosphorothioate linkage
  misc_feature (2)..(3): Phosphorothioate linkage
  modified_base (3)..(3): 2'O-Methyl-adenine
  modified_base (5)..(5): 2'O-Methyl-cytosine
  modified_base (7)..(7): 2'O-Methyl-uracil
  modified_base (9)..(9): 2'O-Methyl-guanine
  modified_base (11)..(11): 2'O-Methyl-adenine
  modified_base (13)..(13): 2'O-Methyl-cytosine
  modified_base (15)..(15): 2'O-Methyl-cytosine
  modified_base (17)..(17): 2'O-Methyl-uracil
  misc_feature (18)..(19): Phosphorothioate linkage
  modified_base (19)..(19): 2'O-Methyl-guanine
  misc_feature (19)..(20): Phosphorothioate linkage
  misc_feature (20)..(21): Phosphorothioate linkage
gcagccugggaccacuuggtt

SEQ ID NO: 703 - DNA, 21 bp, Artificial Sequence
  Description of Combined DNA/RNA molecule: Synthetic oligonucleotide
  Description of Artificial Sequence: Synthetic oligonucleotide
  modified_base (1)..(2): 2'O-Methyl-cytosine
  misc_feature (1)..(2): Phosphorothioate linkage
  modified_base (6)..(6): 2'O-Methyl-uracil
  modified_base (9)..(9): 2'O-Methyl-uracil
  modified_base (10)..(12): 2'O-Methyl-cytosine
  modified_base (16)..(16): 2'O-Methyl-cytosine
  modified_base (17)..(17): 2'O-Methyl-uracil
  modified_base (19)..(19): 2'O-Methyl-cytosine
  misc_feature (20)..(21): Phosphorothioate linkage
ccaaguggucccaggcugctt

SEQ ID NO: 704 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 2'O-Methyl-cytosine
  modified_base (5)..(6): 2'O-Methyl-cytosine
  modified_base (7)..(7): 2'O-Methyl-uracil
  modified_base (12)..(13): 2'O-Methyl-cytosine
  modified_base (15)..(15): 2'O-Methyl-cytosine
  modified_base (16)..(17): 2'O-Methyl-uracil
  misc_feature (20)..(21): Phosphorothioate linkage
gcagccugggaccacuuggtt

SEQ ID NO: 705 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 2'O-Methyl-cytosine
  modified_base (6)..(6): 2'O-Methyl-uracil
  modified_base (12)..(12): 2'O-Methyl-cytosine
  modified_base (17)..(17): 2'O-Methyl-uracil
  misc_feature (20)..(21): Phosphorothioate linkage
ccaaguggucccaggcugctt

SEQ ID NO: 706 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 2'O-Methyl-cytosine
  modified_base (7)..(7): 2'O-Methyl-uracil
  modified_base (13)..(13): 2'O-Methyl-cytosine
  misc_feature (20)..(21): Phosphorothioate linkage
gcagccugggaccacuuggtt

SEQ ID NO: 707 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 2'O-Methyl-cytosine
  modified_base (5)..(6): 2'Fluoro-cytosine
  modified_base (7)..(7): 2'Fluoro-uracil
  modified_base (12)..(13): 2'Fluoro-cytosine
  modified_base (15)..(15): 2'Fluoro-cytosine
  modified_base (16)..(17): 2'Fluoro-uracil
  misc_feature (20)..(21): Phosphorothioate linkage
gcagccugggaccacuuggtt

SEQ ID NO: 708 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 2'Fluoro-cytosine
  modified_base (7)..(7): 2'Fluoro-uracil
  modified_base (13)..(13): 2'Fluoro-cytosine
  modified_base (17)..(17): 2'Fluoro-uracil
  misc_feature (20)..(21): Phosphorothioate linkage
gcagccugggaccacuuggtt

SEQ ID NO: 709 - DNA, 21 bp, Artificial Sequence
  Description of Combined DNA/RNA molecule: Synthetic oligonucleotide
  Description of Artificial Sequence: Synthetic oligonucleotide
caaguggucccaggcugcatt

SEQ ID NO: 710 - DNA, 21 bp, Artificial Sequence
  Description of Combined DNA/RNA molecule: Synthetic oligonucleotide
  Description of Artificial Sequence: Synthetic oligonucleotide
ugcagccugggaccacuugtt

SEQ ID NO: 711 - DNA, 21 bp, Artificial Sequence
  Description of Combined DNA/RNA molecule: Synthetic oligonucleotide
  Description of Artificial Sequence: Synthetic oligonucleotide
  modified_base (2)..(2): 2'O-Methyl-adenine
  modified_base (4)..(4): 2'O-Methyl-guanine
  modified_base (6)..(6): 2'O-Methyl-guanine
  modified_base (8)..(8): 2'O-Methyl-uracil
  modified_base (10)..(10): 2'O-Methyl-cytosine
  modified_base (12)..(12): 2'O-Methyl-adenine
  modified_base (14)..(14): 2'O-Methyl-guanine
  modified_base (16)..(16): 2'O-Methyl-uracil
  modified_base (18)..(18): 2'O-Methyl-cytosine
  misc_feature (20)..(21): Phosphorothioate linkage
caaguggucccaggcugcatt

SEQ ID NO: 712 - DNA, 21 bp, Artificial Sequence
  Description of Combined DNA/RNA molecule: Synthetic oligonucleotide
  Description of Artificial Sequence: Synthetic oligonucleotide
  modified_base (2)..(2): 2'O-Methyl-guanine
  modified_base (4)..(4): 2'O-Methyl-adenine
  modified_base (6)..(6): 2'O-Methyl-cytosine
  modified_base (8)..(8): 2'O-Methyl-uracil
  modified_base (10)..(10): 2'O-Methyl-guanine
  modified_base (12)..(12): 2'O-Methyl-adenine
  modified_base (14)..(14): 2'O-Methyl-cytosine
  modified_base (16)..(16): 2'O-Methyl-cytosine
  modified_base (18)..(18): 2'O-Methyl-uracil
  misc_feature (20)..(21): Phosphorothioate linkage
ugcagccugggaccacuugtt

SEQ ID NO: 713 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-cytosine
  modified_base (3)..(3): 2'O-Methyl-adenine
  modified_base (5)..(5): 2'O-Methyl-uracil
  modified_base (7)..(7): 2'O-Methyl-guanine
  modified_base (9)..(9): 2'O-Methyl-cytosine
  modified_base (11)..(11): 2'O-Methyl-cytosine
  modified_base (13)..(13): 2'O-Methyl-guanine
  modified_base (15)..(15): 2'O-Methyl-cytosine
  modified_base (17)..(17): 2'O-Methyl-guanine
  modified_base (19)..(19): 2'O-Methyl-adenine
  misc_feature (20)..(21): Phosphorothioate linkage
caaguggucccaggcugcatt

SEQ ID NO: 714 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-uracil
  modified_base (3)..(3): 2'O-Methyl-cytosine
  modified_base (5)..(5): 2'O-Methyl-guanine
  modified_base (7)..(7): 2'O-Methyl-cytosine
  modified_base (9)..(9): 2'O-Methyl-guanine
  modified_base (11)..(11): 2'O-Methyl-guanine
  modified_base (13)..(13): 2'O-Methyl-cytosine
  modified_base (15)..(15): 2'O-Methyl-adenine
  modified_base (17)..(17): 2'O-Methyl-uracil
  modified_base (19)..(19): 2'O-Methyl-guanine
  misc_feature (20)..(21): Phosphorothioate linkage
ugcagccugggaccacuugtt

SEQ ID NO: 715 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-cytosine
  modified_base (5)..(5): 2'O-Methyl-uracil
  modified_base (8)..(8): 2'O-Methyl-uracil
  modified_base (9)..(11): 2'O-Methyl-cytosine
  modified_base (15)..(15): 2'O-Methyl-cytosine
  modified_base (16)..(16): 2'O-Methyl-uracil
  modified_base (18)..(18): 2'O-Methyl-cytosine
  misc_feature (20)..(21): Phosphorothioate linkage
caaguggucccaggcugcatt

SEQ ID NO: 716 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-uracil
  modified_base (3)..(3): 2'O-Methyl-cytosine
  modified_base (6)..(7): 2'O-Methyl-cytosine
  modified_base (8)..(8): 2'O-Methyl-uracil
  modified_base (13)..(14): 2'O-Methyl-cytosine
  modified_base (16)..(16): 2'O-Methyl-cytosine
  modified_base (17)..(18): 2'O-Methyl-uracil
  misc_feature (20)..(21): Phosphorothioate linkage
ugcagccugggaccacuugtt

SEQ ID NO: 717 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-cytosine
  modified_base (5)..(5): 2'O-Methyl-uracil
  modified_base (11)..(11): 2'O-Methyl-cytosine
  modified_base (16)..(16): 2'O-Methyl-uracil
  modified_base (18)..(18): 2'O-Methyl-cytosine
  misc_feature (20)..(21): Phosphorothioate linkage
caaguggucccaggcugcatt

SEQ ID NO: 718 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-uracil
  modified_base (3)..(3): 2'O-Methyl-cytosine
  modified_base (8)..(8): 2'O-Methyl-uracil
  modified_base (14)..(14): 2'O-Methyl-cytosine
  modified_base (18)..(18): 2'O-Methyl-uracil
  misc_feature (20)..(21): Phosphorothioate linkage
ugcagccugggaccacuugtt

SEQ ID NO: 719 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'Fluoro-uracil
  modified_base (3)..(3): 2'Fluoro-cytosine
  modified_base (6)..(7): 2'Fluoro-cytosine
  modified_base (8)..(8): 2'Fluoro-uracil
  modified_base (13)..(14): 2'Fluoro-cytosine
  modified_base (16)..(16): 2'Fluoro-cytosine
  modified_base (17)..(18): 2'Fluoro-uracil
  misc_feature (20)..(21): Phosphorothioate linkage
ugcagccugggaccacuugtt

SEQ ID NO: 720 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'Fluoro-uracil
  modified_base (3)..(3): 2'Fluoro-cytosine
  modified_base (8)..(8): 2'Fluoro-uracil
  modified_base (14)..(14): 2'Fluoro-cytosine
  modified_base (18)..(18): 2'Fluoro-uracil
  misc_feature (20)..(21): Phosphorothioate linkage
ugcagccugggaccacuugtt

SEQ ID NO: 721 - DNA, 21 bp, Artificial Sequence
  Description of Combined DNA/RNA molecule: Synthetic oligonucleotide
  Description of Artificial Sequence: Synthetic oligonucleotide
agaaucaucacgaaguggutt

SEQ ID NO: 722 - DNA, 21 bp, Artificial Sequence
  Description of Combined DNA/RNA molecule: Synthetic oligonucleotide
  Description of Artificial Sequence: Synthetic oligonucleotide
accacuucgugaugauucutt

SEQ ID NO: 723 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 2'O-Methyl-guanine
  misc_feature (2)..(3): Phosphorothioate linkage
  modified_base (4)..(4): 2'O-Methyl-adenine
  modified_base (6)..(6): 2'O-Methyl-cytosine
  modified_base (10)..(10): 2'O-Methyl-adenine
  modified_base (12)..(12): 2'O-Methyl-guanine
  modified_base (14)..(14): 2'O-Methyl-adenine
  modified_base (16)..(16): 2'O-Methyl-uracil
  modified_base (18)..(18): 2'O-Methyl-guanine
  misc_feature (18)..(19): Phosphorothioate linkage
  misc_feature (19)..(20): Phosphorothioate linkage
  misc_feature (20)..(21): Phosphorothioate linkage
agaaucaucacgaaguggutt

SEQ ID NO: 724 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 2'O-Methyl-cytosine
  misc_feature (2)..(3): Phosphorothioate linkage
  modified_base (4)..(4): 2'O-Methyl-adenine
  modified_base (6)..(6): 2'O-Methyl-uracil
  modified_base (8)..(8): 2'O-Methyl-cytosine
  modified_base (10)..(10): 2'O-Methyl-uracil
  modified_base (12)..(12): 2'O-Methyl-adenine
  modified_base (14)..(14): 2'O-Methyl-guanine
  modified_base (16)..(16): 2'O-Methyl-uracil
  modified_base (18)..(18): 2'O-Methyl-cytosine
  misc_feature (18)..(19): Phosphorothioate linkage
  misc_feature (19)..(20): Phosphorothioate linkage
  misc_feature (20)..(21): Phosphorothioate linkage
accacuucgugaugauucutt

SEQ ID NO: 725 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-adenine
  misc_feature (1)..(2): Phosphorothioate linkage
  misc_feature (2)..(3): Phosphorothioate linkage
  modified_base (3)..(3): 2'O-Methyl-adenine
  modified_base (5)..(5): 2'O-Methyl-uracil
  modified_base (7)..(7): 2'O-Methyl-adenine
  modified_base (9)..(9): 2'O-Methyl-cytosine
  modified_base (11)..(11): 2'O-Methyl-cytosine
  modified_base (13)..(13): 2'O-Methyl-adenine
  modified_base (15)..(15): 2'O-Methyl-guanine
  modified_base (17)..(17): 2'O-Methyl-guanine
  misc_feature (18)..(19): Phosphorothioate linkage
  modified_base (19)..(19): 2'O-Methyl-uracil
  misc_feature (19)..(20): Phosphorothioate linkage
  misc_feature (20)..(21): Phosphorothioate linkage
agaaucaucacgaaguggutt

SEQ ID NO: 726 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-adenine
  misc_feature (1)..(2): Phosphorothioate linkage
  misc_feature (2)..(3): Phosphorothioate linkage
  modified_base (3)..(3): 2'O-Methyl-cytosine
  modified_base (5)..(5): 2'O-Methyl-cytosine
  modified_base (7)..(7): 2'O-Methyl-uracil
  modified_base (9)..(9): 2'O-Methyl-guanine
  modified_base (11)..(11): 2'O-Methyl-guanine
  modified_base (13)..(13): 2'O-Methyl-uracil
  modified_base (15)..(15): 2'O-Methyl-adenine
  modified_base (17)..(17): 2'O-Methyl-uracil
  misc_feature (18)..(19): Phosphorothioate linkage
  modified_base (19)..(19): 2'O-Methyl-uracil
  misc_feature (19)..(20): Phosphorothioate linkage
  misc_feature (20)..(21): Phosphorothioate linkage
accacuucgugaugauucutt

SEQ ID NO: 727 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-adenine
  misc_feature (1)..(2): Phosphorothioate linkage
  modified_base (5)..(5): 2'O-Methyl-uracil
  modified_base (6)..(6): 2'O-Methyl-cytosine
  modified_base (8)..(8): 2'O-Methyl-uracil
  modified_base (9)..(9): 2'O-Methyl-cytosine
  modified_base (11)..(11): 2'O-Methyl-cytosine
  modified_base (16)..(16): 2'O-Methyl-uracil
  modified_base (19)..(19): 2'O-Methyl-uracil
  misc_feature (20)..(21): Phosphorothioate linkage
agaaucaucacgaaguggutt

SEQ ID NO: 728 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(3): 2'O-Methyl-cytosine
  modified_base (5)..(5): 2'O-Methyl-cytosine
  modified_base (6)..(7): 2'O-Methyl-uracil
  modified_base (8)..(8): 2'O-Methyl-cytosine
  modified_base (10)..(10): 2'O-Methyl-uracil
  modified_base (13)..(13): 2'O-Methyl-uracil
  modified_base (16)..(17): 2'O-Methyl-uracil
  modified_base (18)..(18): 2'O-Methyl-cytosine
  modified_base (19)..(19): 2'O-Methyl-uracil
  misc_feature (20)..(21): Phosphorothioate linkage
accacuucgugaugauucutt

SEQ ID NO: 729 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (6)..(6): 2'O-Methyl-cytosine
  modified_base (9)..(9): 2'O-Methyl-cytosine
  modified_base (16)..(16): 2'O-Methyl-uracil
  misc_feature (20)..(21): Phosphorothioate linkage
agaaucaucacgaaguggutt

SEQ ID NO: 730 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (3)..(3): 2'O-Methyl-cytosine
  modified_base (10)..(10): 2'O-Methyl-uracil
  modified_base (13)..(13): 2'O-Methyl-uracil
  misc_feature (20)..(21): Phosphorothioate linkage
accacuucgugaugauucutt

SEQ ID NO: 731 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(3): 2'Fluoro-cytosine
  modified_base (5)..(5): 2'Fluoro-cytosine
  modified_base (6)..(7): 2'Fluoro-uracil
  modified_base (8)..(8): 2'O-Methyl-cytosine
  modified_base (10)..(10): 2'Fluoro-uracil
  modified_base (13)..(13): 2'Fluoro-uracil
  modified_base (16)..(17): 2'Fluoro-uracil
  modified_base (18)..(18): 2'Fluoro-cytosine
  modified_base (19)..(19): 2'Fluoro-uracil
  misc_feature (20)..(21): Phosphorothioate linkage
accacuucgugaugauucutt

SEQ ID NO: 732 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (3)..(3): 2'Fluoro-cytosine
  modified_base (10)..(10): 2'Fluoro-uracil
  modified_base (13)..(13): 2'Fluoro-uracil
  misc_feature (20)..(21): Phosphorothioate linkage
accacuucgugaugauucutt

SEQ ID NO: 733 - DNA, 21 bp, Artificial Sequence
  Description of Combined DNA/RNA molecule: Synthetic oligonucleotide
  Description of Artificial Sequence: Synthetic oligonucleotide
uggaugucuaucagcgcagtt

SEQ ID NO: 734 - DNA, 21 bp, Artificial Sequence
  Description of Combined DNA/RNA molecule: Synthetic oligonucleotide
  Description of Artificial Sequence: Synthetic oligonucleotide
cugcgcugauagacauccatt

SEQ ID NO: 735 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 2'O-Methyl-guanine
  misc_feature (2)..(3): Phosphorothioate linkage
  modified_base (4)..(4): 2'O-Methyl-adenine
  modified_base (6)..(6): 2'O-Methyl-guanine
  modified_base (8)..(8): 2'O-Methyl-cytosine
  modified_base (10)..(10): 2'O-Methyl-adenine
  modified_base (12)..(12): 2'O-Methyl-cytosine
  modified_base (14)..(14): 2'O-Methyl-guanine
  modified_base (16)..(16): 2'O-Methyl-guanine
  modified_base (18)..(18): 2'O-Methyl-adenine
  misc_feature (18)..(19): Phosphorothioate linkage
  misc_feature (19)..(20): Phosphorothioate linkage
  misc_feature (20)..(21): Phosphorothioate linkage
uggaugucuaucagcgcagtt

SEQ ID NO: 736 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 2'O-Methyl-uracil
  misc_feature (2)..(3): Phosphorothioate linkage
  modified_base (4)..(4): 2'O-Methyl-cytosine
  modified_base (6)..(6): 2'O-Methyl-cytosine
  modified_base (8)..(8): 2'O-Methyl-guanine
  modified_base (10)..(10): 2'O-Methyl-uracil
  modified_base (12)..(12): 2'O-Methyl-guanine
  modified_base (14)..(14): 2'O-Methyl-cytosine
  modified_base (16)..(16): 2'O-Methyl-uracil
  modified_base (18)..(18): 2'O-Methyl-cytosine
  misc_feature (18)..(19): Phosphorothioate linkage
  misc_feature (19)..(20): Phosphorothioate linkage
  misc_feature (20)..(21): Phosphorothioate linkage
cugcgcugauagacauccatt

SEQ ID NO: 737 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-uracil
  misc_feature (1)..(2): Phosphorothioate linkage
  misc_feature (2)..(3): Phosphorothioate linkage
  modified_base (3)..(3): 2'O-Methyl-guanine
  modified_base (5)..(5): 2'O-Methyl-uracil
  modified_base (7)..(7): 2'O-Methyl-uracil
  modified_base (9)..(9): 2'O-Methyl-uracil
  modified_base (11)..(11): 2'O-Methyl-uracil
  modified_base (13)..(13): 2'O-Methyl-adenine
  modified_base (15)..(15): 2'O-Methyl-cytosine
  modified_base (17)..(17): 2'O-Methyl-cytosine
  misc_feature (18)..(19): Phosphorothioate linkage
  modified_base (19)..(19): 2'O-Methyl-guanine
  misc_feature (19)..(20): Phosphorothioate linkage
  misc_feature (20)..(21): Phosphorothioate linkage
uggaugucuaucagcgcagtt

SEQ ID NO: 738 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-cytosine
  misc_feature (1)..(2): Phosphorothioate linkage
  misc_feature (2)..(3): Phosphorothioate linkage
  modified_base (3)..(3): 2'O-Methyl-guanine
  modified_base (5)..(5): 2'O-Methyl-guanine
  modified_base (7)..(7): 2'O-Methyl-uracil
  modified_base (9)..(9): 2'O-Methyl-adenine
  modified_base (11)..(11): 2'O-Methyl-adenine
  modified_base (13)..(13): 2'O-Methyl-adenine
  modified_base (15)..(15): 2'O-Methyl-adenine
  modified_base (17)..(17): 2'O-Methyl-cytosine
  misc_feature (18)..(19): Phosphorothioate linkage
  modified_base (19)..(19): 2'O-Methyl-adenine
  misc_feature (19)..(20): Phosphorothioate linkage
  misc_feature (20)..(21): Phosphorothioate linkage
cugcgcugauagacauccatt

SEQ ID NO: 739 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-uracil
  misc_feature (1)..(2): Phosphorothioate linkage
  modified_base (5)..(5): 2'O-Methyl-uracil
  modified_base (8)..(8): 2'O-Methyl-cytosine
  modified_base (9)..(9): 2'O-Methyl-uracil
  modified_base (11)..(11): 2'O-Methyl-uracil
  modified_base (12)..(12): 2'O-Methyl-cytosine
  modified_base (15)..(15): 2'O-Methyl-cytosine
  modified_base (17)..(17): 2'O-Methyl-cytosine
  modified_base (18)..(18): 2'O-Methyl-adenine
  misc_feature (20)..(21): Phosphorothioate linkage
uggaugucuaucagcgcagtt

SEQ ID NO: 740 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-cytosine
  misc_feature (1)..(2): Phosphorothioate linkage
  modified_base (2)..(2): 2'O-Methyl-uracil
  modified_base (4)..(4): 2'O-Methyl-cytosine
  modified_base (6)..(6): 2'O-Methyl-cytosine
  modified_base (7)..(7): 2'O-Methyl-uracil
  modified_base (10)..(10): 2'O-Methyl-uracil
  modified_base (14)..(14): 2'O-Methyl-cytosine
  modified_base (16)..(16): 2'O-Methyl-uracil
  modified_base (17)..(18): 2'O-Methyl-cytosine
  misc_feature (20)..(21): Phosphorothioate linkage
cugcgcugauagacauccatt

SEQ ID NO: 741 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (5)..(5): 2'O-Methyl-uracil
  modified_base (9)..(9): 2'O-Methyl-uracil
  modified_base (12)..(12): 2'O-Methyl-cytosine
  modified_base (17)..(17): 2'O-Methyl-cytosine
  misc_feature (20)..(21): Phosphorothioate linkage
uggaugucuaucagcgcagtt

SEQ ID NO: 742 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 2'O-Methyl-uracil
  modified_base (7)..(7): 2'O-Methyl-uracil
  modified_base (10)..(10): 2'O-Methyl-uracil
  modified_base (14)..(14): 2'O-Methyl-cytosine
  modified_base (18)..(18): 2'O-Methyl-cytosine
  misc_feature (20)..(21): Phosphorothioate linkage
cugcgcugauagacauccatt

SEQ ID NO: 743 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'Fluoro-cytosine
  misc_feature (1)..(2): Phosphorothioate linkage
  modified_base (2)..(2): 2'Fluoro-uracil
  modified_base (4)..(4): 2'Fluoro-cytosine
  modified_base (6)..(6): 2'Fluoro-cytosine
  modified_base (7)..(7): 2'Fluoro-uracil
  modified_base (10)..(10): 2'O-Methyl-uracil
  modified_base (14)..(14): 2'Fluoro-cytosine
  modified_base (16)..(16): 2'Fluoro-uracil
  modified_base (17)..(18): 2'Fluoro-cytosine
  misc_feature (20)..(21): Phosphorothioate linkage
cugcgcugauagacauccatt

SEQ ID NO: 744 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (5)..(5): 2'O-Methyl-uracil
  modified_base (9)..(9): 2'O-Methyl-uracil
  modified_base (12)..(12): 2'O-Methyl-cytosine
  modified_base (17)..(17): 2'O-Methyl-cytosine
  misc_feature (20)..(21): Phosphorothioate linkage
uggaugucuaucagcgcagtt

SEQ ID NO: 745 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 2'Fluoro-uracil
  modified_base (7)..(7): 2'Fluoro-uracil
  modified_base (10)..(10): 2'Fluoro-uracil
  modified_base (14)..(14): 2'Fluoro-cytosine
  modified_base (18)..(18): 2'Fluoro-cytosine
  misc_feature (20)..(21): Phosphorothioate linkage
cugcgcugauagacauccatt

SEQ ID NO: 746 - DNA, 21 bp, Artificial Sequence
  Description of Combined DNA/RNA molecule: Synthetic oligonucleotide
  Description of Artificial Sequence: Synthetic oligonucleotide
uacugccauccaaucgagatt

SEQ ID NO: 747 - DNA, 21 bp, Artificial Sequence
  Description of Combined DNA/RNA molecule: Synthetic oligonucleotide
  Description of Artificial Sequence: Synthetic oligonucleotide
ucucgauuggauggcaguatt

SEQ ID NO: 748 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 2'O-Methyl-adenine
  misc_feature (2)..(3): Phosphorothioate linkage
  modified_base (4)..(4): 2'O-Methyl-uracil
  modified_base (6)..(6): 2'O-Methyl-cytosine
  modified_base (8)..(8): 2'O-Methyl-adenine
  modified_base (10)..(10): 2'O-Methyl-cytosine
  modified_base (12)..(12): 2'O-Methyl-adenine
  modified_base (14)..(14): 2'O-Methyl-uracil
  modified_base (16)..(16): 2'O-Methyl-guanine
  modified_base (18)..(18): 2'O-Methyl-guanine
  misc_feature (18)..(19): Phosphorothioate linkage
  misc_feature (19)..(20): Phosphorothioate linkage
  misc_feature (20)..(21): Phosphorothioate linkage
uacugccauccaaucgagatt

SEQ ID NO: 749 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 2'O-Methyl-cytosine
  misc_feature (2)..(3): Phosphorothioate linkage
  modified_base (4)..(4): 2'O-Methyl-cytosine
  modified_base (6)..(6): 2'O-Methyl-adenine
  modified_base (8)..(8): 2'O-Methyl-uracil
  modified_base (10)..(10): 2'O-Methyl-guanine
  modified_base (12)..(12): 2'O-Methyl-uracil
  modified_base (14)..(14): 2'O-Methyl-guanine
  modified_base (16)..(16): 2'O-Methyl-adenine
  modified_base (18)..(18): 2'O-Methyl-uracil
  misc_feature (18)..(19): Phosphorothioate linkage
  misc_feature (19)..(20): Phosphorothioate linkage
  misc_feature (20)..(21): Phosphorothioate linkage
ucucgauuggauggcaguatt

SEQ ID NO: 750 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-uracil
  misc_feature (1)..(2): Phosphorothioate linkage
  misc_feature (2)..(3): Phosphorothioate linkage
  modified_base (3)..(3): 2'O-Methyl-cytosine
  modified_base (5)..(5): 2'O-Methyl-guanine
  modified_base (7)..(7): 2'O-Methyl-cytosine
  modified_base (9)..(9): 2'O-Methyl-uracil
  modified_base (11)..(11): 2'O-Methyl-cytosine
  modified_base (13)..(13): 2'O-Methyl-adenine
  modified_base (15)..(15): 2'O-Methyl-cytosine
  modified_base (17)..(17): 2'O-Methyl-adenine
  misc_feature (18)..(19): Phosphorothioate linkage
  modified_base (19)..(19): 2'O-Methyl-adenine
  misc_feature (19)..(20): Phosphorothioate linkage
  misc_feature (20)..(21): Phosphorothioate linkage
uacugccauccaaucgagatt

SEQ ID NO: 751 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-uracil
  misc_feature (1)..(2): Phosphorothioate linkage
  misc_feature (2)..(3): Phosphorothioate linkage
  modified_base (3)..(3): 2'O-Methyl-uracil
  modified_base (5)..(5): 2'O-Methyl-guanine
  modified_base (7)..(7): 2'O-Methyl-uracil
  modified_base (9)..(9): 2'O-Methyl-guanine
  modified_base (11)..(11): 2'O-Methyl-adenine
  modified_base (13)..(13): 2'O-Methyl-guanine
  modified_base (15)..(15): 2'O-Methyl-cytosine
  modified_base (17)..(17): 2'O-Methyl-guanine
  misc_feature (18)..(19): Phosphorothioate linkage
  modified_base (19)..(19): 2'O-Methyl-adenine
  misc_feature (19)..(20): Phosphorothioate linkage
  misc_feature (20)..(21): Phosphorothioate linkage
ucucgauuggauggcaguatt

SEQ ID NO: 752 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-uracil
  misc_feature (1)..(2): Phosphorothioate linkage
  modified_base (3)..(3): 2'O-Methyl-cytosine
  modified_base (4)..(4): 2'O-Methyl-uracil
  modified_base (6)..(7): 2'O-Methyl-cytosine
  modified_base (9)..(9): 2'O-Methyl-uracil
  modified_base (10)..(11): 2'O-Methyl-cytosine
  modified_base (14)..(14): 2'O-Methyl-uracil
  modified_base (15)..(15): 2'O-Methyl-cytosine
  misc_feature (20)..(21): Phosphorothioate linkage
uacugccauccaaucgagatt

SEQ ID NO: 753 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-uracil
  misc_feature (1)..(2): Phosphorothioate linkage
  modified_base (2)..(2): 2'O-Methyl-cytosine
  modified_base (3)..(3): 2'O-Methyl-uracil
  modified_base (4)..(4): 2'O-Methyl-cytosine
  modified_base (7)..(8): 2'O-Methyl-uracil
  modified_base (12)..(12): 2'O-Methyl-uracil
  modified_base (15)..(15): 2'O-Methyl-cytosine
  modified_base (18)..(18): 2'O-Methyl-uracil
  misc_feature (20)..(21): Phosphorothioate linkage
ucucgauuggauggcaguatt

SEQ ID NO: 754 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (4)..(4): 2'O-Methyl-uracil
  modified_base (7)..(7): 2'O-Methyl-cytosine
  modified_base (11)..(11): 2'O-Methyl-cytosine
  misc_feature (20)..(21): Phosphorothioate linkage
uacugccauccaaucgagatt

SEQ ID NO: 755 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (8)..(8): 2'O-Methyl-uracil
  modified_base (12)..(12): 2'O-Methyl-uracil
  modified_base (15)..(15): 2'O-Methyl-cytosine
  modified_base (18)..(18): 2'O-Methyl-uracil
  misc_feature (20)..(21): Phosphorothioate linkage
ucucgauuggauggcaguatt

SEQ ID NO: 756 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'Fluoro-uracil
  misc_feature (1)..(2): Phosphorothioate linkage
  modified_base (2)..(2): 2'Fluoro-cytosine
  modified_base (3)..(3): 2'Fluoro-uracil
  modified_base (4)..(4): 2'Fluoro-cytosine
  modified_base (7)..(8): 2'Fluoro-uracil
  modified_base (12)..(12): 2'Fluoro-uracil
  modified_base (15)..(15): 2'Fluoro-cytosine
  modified_base (18)..(18): 2'Fluoro-uracil
  misc_feature (20)..(21): Phosphorothioate linkage
ucucgauuggauggcaguatt

SEQ ID NO: 757 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (8)..(8): 2'Fluoro-uracil
  modified_base (12)..(12): 2'Fluoro-uracil
  modified_base (15)..(15): 2'Fluoro-cytosine
  modified_base (18)..(18): 2'Fluoro-uracil
  misc_feature (20)..(21): Phosphorothioate linkage
ucucgauuggauggcaguatt

SEQ ID NO: 758 - DNA, 21 bp, Artificial Sequence
  Description of Combined DNA/RNA molecule: Synthetic oligonucleotide
  Description of Artificial Sequence: Synthetic oligonucleotide
cccugguggacaucuuccatt

SEQ ID NO: 759 - DNA, 21 bp, Artificial Sequence
  Description of Combined DNA/RNA molecule: Synthetic oligonucleotide
  Description of Artificial Sequence: Synthetic oligonucleotide
uggaagauguccaccagggtt

SEQ ID NO: 760 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 2'O-Methyl-cytosine
  misc_feature (2)..(3): Phosphorothioate linkage
  modified_base (4)..(4): 2'O-Methyl-uracil
  modified_base (6)..(6): 2'O-Methyl-guanine
  modified_base (8)..(8): 2'O-Methyl-guanine
  modified_base (10)..(10): 2'O-Methyl-adenine
  modified_base (12)..(12): 2'O-Methyl-adenine
  modified_base (14)..(14): 2'O-Methyl-cytosine
  modified_base (16)..(16): 2'O-Methyl-uracil
  modified_base (18)..(18): 2'O-Methyl-cytosine
  misc_feature (18)..(19): Phosphorothioate linkage
  misc_feature (19)..(20): Phosphorothioate linkage
  misc_feature (20)..(21): Phosphorothioate linkage
cccugguggacaucuuccatt

SEQ ID NO: 761 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 2'O-Methyl-guanine
  misc_feature (2)..(3): Phosphorothioate linkage
  modified_base (4)..(4): 2'O-Methyl-adenine
  modified_base (6)..(6): 2'O-Methyl-guanine
  modified_base (8)..(8): 2'O-Methyl-uracil
  modified_base (10)..(10): 2'O-Methyl-uracil
  modified_base (12)..(12): 2'O-Methyl-cytosine
  modified_base (14)..(14): 2'O-Methyl-cytosine
  modified_base (16)..(16): 2'O-Methyl-adenine
  modified_base (18)..(18): 2'O-Methyl-guanine
  misc_feature (18)..(19): Phosphorothioate linkage
  misc_feature (19)..(20): Phosphorothioate linkage
  misc_feature (20)..(21): Phosphorothioate linkage
uggaagauguccaccagggtt

SEQ ID NO: 762 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-cytosine
  misc_feature (1)..(2): Phosphorothioate linkage
  misc_feature (2)..(3): Phosphorothioate linkage
  modified_base (3)..(3): 2'O-Methyl-cytosine
  modified_base (5)..(5): 2'O-Methyl-guanine
  modified_base (7)..(7): 2'O-Methyl-uracil
  modified_base (9)..(9): 2'O-Methyl-guanine
  modified_base (11)..(11): 2'O-Methyl-cytosine
  modified_base (13)..(13): 2'O-Methyl-uracil
  modified_base (15)..(15): 2'O-Methyl-uracil
  modified_base (17)..(17): 2'O-Methyl-cytosine
  misc_feature (18)..(19): Phosphorothioate linkage
  modified_base (19)..(19): 2'O-Methyl-adenine
  misc_feature (19)..(20): Phosphorothioate linkage
  misc_feature (20)..(21): Phosphorothioate linkage
cccugguggacaucuuccatt

SEQ ID NO: 763 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-uracil
  misc_feature (1)..(2): Phosphorothioate linkage
  misc_feature (2)..(3): Phosphorothioate linkage
  modified_base (3)..(3): 2'O-Methyl-guanine
  modified_base (5)..(5): 2'O-Methyl-adenine
  modified_base (7)..(7): 2'O-Methyl-adenine
  modified_base (9)..(9): 2'O-Methyl-guanine
  modified_base (11)..(11): 2'O-Methyl-cytosine
  modified_base (13)..(13): 2'O-Methyl-adenine
  modified_base (15)..(15): 2'O-Methyl-cytosine
  modified_base (17)..(17): 2'O-Methyl-guanine
  misc_feature (18)..(19): Phosphorothioate linkage
  modified_base (19)..(19): 2'O-Methyl-guanine
  misc_feature (19)..(20): Phosphorothioate linkage
  misc_feature (20)..(21): Phosphorothioate linkage
uggaagauguccaccagggtt

SEQ ID NO: 764 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-cytosine
  misc_feature (1)..(2): Phosphorothioate linkage
  modified_base (2)..(3): 2'O-Methyl-cytosine
  modified_base (4)..(4): 2'O-Methyl-uracil
  modified_base (7)..(7): 2'O-Methyl-uracil
  modified_base (11)..(11): 2'O-Methyl-cytosine
  modified_base (13)..(13): 2'O-Methyl-uracil
  modified_base (14)..(14): 2'O-Methyl-cytosine
  modified_base (15)..(16): 2'O-Methyl-uracil
  modified_base (17)..(18): 2'O-Methyl-cytosine
  misc_feature (20)..(21): Phosphorothioate linkage
cccugguggacaucuuccatt

SEQ ID NO: 765 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-uracil
  misc_feature (1)..(2): Phosphorothioate linkage
  modified_base (8)..(8): 2'O-Methyl-uracil
  modified_base (10)..(10): 2'O-Methyl-uracil
  modified_base (11)..(12): 2'O-Methyl-cytosine
  modified_base (14)..(15): 2'O-Methyl-cytosine
  misc_feature (20)..(21): Phosphorothioate linkage
uggaagauguccaccagggtt

SEQ ID NO: 766 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (4)..(4): 2'O-Methyl-uracil
  modified_base (7)..(7): 2'O-Methyl-uracil
  modified_base (11)..(11): 2'O-Methyl-cytosine
  modified_base (18)..(18): 2'O-Methyl-cytosine
  misc_feature (20)..(21): Phosphorothioate linkage
cccugguggacaucuuccatt

SEQ ID NO: 767 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-uracil
  misc_feature (1)..(2): Phosphorothioate linkage
  modified_base (8)..(8): 2'O-Methyl-uracil
  modified_base (12)..(12): 2'O-Methyl-cytosine
  modified_base (15)..(15): 2'O-Methyl-cytosine
  misc_feature (20)..(21): Phosphorothioate linkage
uggaagauguccaccagggtt

SEQ ID NO: 768 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'Fluoro-uracil
  misc_feature (1)..(2): Phosphorothioate linkage
  modified_base (8)..(8): 2'Fluoro-uracil
  modified_base (10)..(10): 2'Fluoro-uracil
  modified_base (11)..(12): 2'Fluoro-cytosine
  modified_base (14)..(15): 2'Fluoro-cytosine
  misc_feature (20)..(21): Phosphorothioate linkage
uggaagauguccaccagggtt

SEQ ID NO: 769 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'Fluoro-uracil
  misc_feature (1)..(2): Phosphorothioate linkage
  modified_base (8)..(8): 2'Fluoro-uracil
  modified_base (12)..(12): 2'Fluoro-cytosine
  modified_base (15)..(15): 2'Fluoro-cytosine
  misc_feature (20)..(21): Phosphorothioate linkage
uggaagauguccaccagggtt

SEQ ID NO: 770 - DNA, 21 bp, Artificial Sequence
  Description of Combined DNA/RNA molecule: Synthetic oligonucleotide
  Description of Artificial Sequence: Synthetic oligonucleotide
ggacaucuuccaggaguactt

SEQ ID NO: 771 - DNA, 21 bp, Artificial Sequence
  Description of Combined DNA/RNA molecule: Synthetic oligonucleotide
  Description of Artificial Sequence: Synthetic oligonucleotide
guacuccuggaagaugucctt

SEQ ID NO: 772 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 2'O-Methyl-guanine
  misc_feature (2)..(3): Phosphorothioate linkage
  modified_base (4)..(4): 2'O-Methyl-cytosine
  modified_base (6)..(6): 2'O-Methyl-uracil
  modified_base (8)..(8): 2'O-Methyl-uracil
  modified_base (10)..(10): 2'O-Methyl-cytosine
  modified_base (12)..(12): 2'O-Methyl-adenine
  modified_base (14)..(14): 2'O-Methyl-guanine
  modified_base (16)..(16): 2'O-Methyl-guanine
  modified_base (18)..(18): 2'O-Methyl-adenine
  misc_feature (18)..(19): Phosphorothioate linkage
  misc_feature (19)..(20): Phosphorothioate linkage
  misc_feature (20)..(21): Phosphorothioate linkage
ggacaucuuccaggaguactt

SEQ ID NO: 773 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 2'O-Methyl-uracil
  misc_feature (2)..(3): Phosphorothioate linkage
  modified_base (4)..(4): 2'O-Methyl-cytosine
  modified_base (6)..(6): 2'O-Methyl-cytosine
  modified_base (8)..(8): 2'O-Methyl-uracil
  modified_base (10)..(10): 2'O-Methyl-guanine
  modified_base (12)..(12): 2'O-Methyl-adenine
  modified_base (14)..(14): 2'O-Methyl-adenine
  modified_base (16)..(16): 2'O-Methyl-guanine
  modified_base (18)..(18): 2'O-Methyl-cytosine
  misc_feature (18)..(19): Phosphorothioate linkage
  misc_feature (19)..(20): Phosphorothioate linkage
  misc_feature (20)..(21): Phosphorothioate linkage
guacuccuggaagaugucctt

SEQ ID NO: 774 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-guanine
  misc_feature (1)..(2): Phosphorothioate linkage
  misc_feature (2)..(3): Phosphorothioate linkage
  modified_base (3)..(3): 2'O-Methyl-adenine
  modified_base (5)..(5): 2'O-Methyl-adenine
  modified_base (7)..(7): 2'O-Methyl-cytosine
  modified_base (9)..(9): 2'O-Methyl-uracil
  modified_base (11)..(11): 2'O-Methyl-cytosine
  modified_base (13)..(13): 2'O-Methyl-guanine
  modified_base (15)..(15): 2'O-Methyl-adenine
  modified_base (17)..(17): 2'O-Methyl-uracil
  misc_feature (18)..(19): Phosphorothioate linkage
  modified_base (19)..(19): 2'O-Methyl-cytosine
  misc_feature (19)..(20): Phosphorothioate linkage
  misc_feature (20)..(21): Phosphorothioate linkage
ggacaucuuccaggaguactt

SEQ ID NO: 775 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-guanine
  misc_feature (1)..(2): Phosphorothioate linkage
  misc_feature (2)..(3): Phosphorothioate linkage
  modified_base (3)..(3): 2'O-Methyl-adenine
  modified_base (5)..(5): 2'O-Methyl-uracil
  modified_base (7)..(7): 2'O-Methyl-cytosine
  modified_base (9)..(9): 2'O-Methyl-guanine
  modified_base (11)..(11): 2'O-Methyl-adenine
  modified_base (13)..(13): 2'O-Methyl-guanine
  modified_base (15)..(15): 2'O-Methyl-uracil
  modified_base (17)..(17): 2'O-Methyl-uracil
  misc_feature (18)..(19): Phosphorothioate linkage
  modified_base (19)..(19): 2'O-Methyl-cytosine
  misc_feature (19)..(20): Phosphorothioate linkage
  misc_feature (20)..(21): Phosphorothioate linkage
guacuccuggaagaugucctt

SEQ ID NO: 776 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-guanine
  misc_feature (1)..(2): Phosphorothioate linkage
  modified_base (4)..(4): 2'O-Methyl-cytosine
  modified_base (6)..(6): 2'O-Methyl-uracil
  modified_base (7)..(7): 2'O-Methyl-cytosine
  modified_base (8)..(9): 2'O-Methyl-uracil
  modified_base (10)..(11): 2'O-Methyl-cytosine
  modified_base (17)..(17): 2'O-Methyl-uracil
  modified_base (19)..(19): 2'O-Methyl-cytosine
  misc_feature (20)..(21): Phosphorothioate linkage
ggacaucuuccaggaguactt

SEQ ID NO: 777 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 2'O-Methyl-uracil
  modified_base (4)..(4): 2'O-Methyl-cytosine
  modified_base (5)..(5): 2'O-Methyl-uracil
  modified_base (6)..(7): 2'O-Methyl-cytosine
  modified_base (8)..(8): 2'O-Methyl-uracil
  modified_base (15)..(15): 2'O-Methyl-uracil
  modified_base (17)..(17): 2'O-Methyl-uracil
  modified_base (18)..(19): 2'O-Methyl-cytosine
  misc_feature (20)..(21): Phosphorothioate linkage
guacuccuggaagaugucctt

SEQ ID NO: 778 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (4)..(4): 2'O-Methyl-cytosine
  modified_base (11)..(11): 2'O-Methyl-cytosine
  modified_base (17)..(17): 2'O-Methyl-uracil
  misc_feature (20)..(21): Phosphorothioate linkage
ggacaucuuccaggaguactt

SEQ ID NO: 779 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 2'O-Methyl-uracil
  modified_base (8)..(8): 2'O-Methyl-uracil
  modified_base (15)..(15): 2'O-Methyl-uracil
  misc_feature (20)..(21): Phosphorothioate linkage
guacuccuggaagaugucctt

SEQ ID NO: 780 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 2'Fluoro-uracil
  modified_base (4)..(4): 2'Fluoro-cytosine
  modified_base (5)..(5): 2'Fluoro-uracil
  modified_base (6)..(7): 2'Fluoro-cytosine
  modified_base (8)..(8): 2'Fluoro-uracil
  modified_base (15)..(15): 2'Fluoro-uracil
  modified_base (17)..(17): 2'Fluoro-uracil
  modified_base (18)..(19): 2'Fluoro-cytosine
  misc_feature (20)..(21): Phosphorothioate linkage
guacuccuggaagaugucctt

SEQ ID NO: 781 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 2'Fluoro-uracil
  modified_base (8)..(8): 2'Fluoro-uracil
  modified_base (15)..(15): 2'Fluoro-uracil
  misc_feature (20)..(21): Phosphorothioate linkage
guacuccuggaagaugucctt

SEQ ID NO: 782 - DNA, 21 bp, Artificial Sequence
  Description of Combined DNA/RNA molecule: Synthetic oligonucleotide
  Description of Artificial Sequence: Synthetic oligonucleotide
uacccugaugagaucgagutt

SEQ ID NO: 783 - DNA, 21 bp, Artificial Sequence
  Description of Combined DNA/RNA molecule: Synthetic oligonucleotide
  Description of Artificial Sequence: Synthetic oligonucleotide
acucgaucucaucaggguatt

SEQ ID NO: 784 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 2'O-Methyl-adenine
  misc_feature (2)..(3): Phosphorothioate linkage
  modified_base (4)..(4): 2'O-Methyl-cytosine
  modified_base (6)..(6): 2'O-Methyl-uracil
  modified_base (8)..(8): 2'O-Methyl-adenine
  modified_base (10)..(10): 2'O-Methyl-guanine
  modified_base (12)..(12): 2'O-Methyl-guanine
  modified_base (14)..(14): 2'O-Methyl-uracil
  modified_base (16)..(16): 2'O-Methyl-guanine
  modified_base (18)..(18): 2'O-Methyl-guanine
  misc_feature (18)..(19): Phosphorothioate linkage
  misc_feature (19)..(20): Phosphorothioate linkage
  misc_feature (20)..(21): Phosphorothioate linkage
uacccugaugagaucgagutt

SEQ ID NO: 785 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 2'O-Methyl-cytosine
  misc_feature (2)..(3): Phosphorothioate linkage
  modified_base (4)..(4): 2'O-Methyl-cytosine
  modified_base (6)..(6): 2'O-Methyl-adenine
  modified_base (8)..(8): 2'O-Methyl-cytosine
  modified_base (10)..(10): 2'O-Methyl-cytosine
  modified_base (12)..(12): 2'O-Methyl-uracil
  modified_base (14)..(14): 2'O-Methyl-adenine
  modified_base (16)..(16): 2'O-Methyl-guanine
  modified_base (18)..(18): 2'O-Methyl-uracil
  misc_feature (18)..(19): Phosphorothioate linkage
  misc_feature (19)..(20): Phosphorothioate linkage
  misc_feature (20)..(21): Phosphorothioate linkage
acucgaucucaucaggguatt

SEQ ID NO: 786 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-uracil
  misc_feature (1)..(2): Phosphorothioate linkage
  misc_feature (2)..(3): Phosphorothioate linkage
  modified_base (3)..(3): 2'O-Methyl-cytosine
  modified_base (5)..(5): 2'O-Methyl-cytosine
  modified_base (7)..(7): 2'O-Methyl-guanine
  modified_base (9)..(9): 2'O-Methyl-uracil
  modified_base (11)..(11): 2'O-Methyl-adenine
  modified_base (13)..(13): 2'O-Methyl-adenine
  modified_base (15)..(15): 2'O-Methyl-cytosine
  modified_base (17)..(17): 2'O-Methyl-adenine
  misc_feature (18)..(19): Phosphorothioate linkage
  modified_base (19)..(19): 2'O-Methyl-uracil
  misc_feature (19)..(20): Phosphorothioate linkage
  misc_feature (20)..(21): Phosphorothioate linkage
uacccugaugagaucgagutt

SEQ ID NO: 787 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-adenine
  misc_feature (1)..(2): Phosphorothioate linkage
  misc_feature (2)..(3): Phosphorothioate linkage
  modified_base (3)..(3): 2'O-Methyl-uracil
  modified_base (5)..(5): 2'O-Methyl-guanine
  modified_base (7)..(7): 2'O-Methyl-uracil
  modified_base (9)..(9): 2'O-Methyl-uracil
  modified_base (11)..(11): 2'O-Methyl-adenine
  modified_base (13)..(13): 2'O-Methyl-cytosine
  modified_base (15)..(15): 2'O-Methyl-guanine
  modified_base (17)..(17): 2'O-Methyl-guanine
  misc_feature (18)..(19): Phosphorothioate linkage
  modified_base (19)..(19): 2'O-Methyl-adenine
  misc_feature (19)..(20): Phosphorothioate linkage
  misc_feature (20)..(21): Phosphorothioate linkage
acucgaucucaucaggguatt

SEQ ID NO: 788 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-uracil
  misc_feature (1)..(2): Phosphorothioate linkage
  modified_base (3)..(5): 2'O-Methyl-cytosine
  modified_base (6)..(6): 2'O-Methyl-uracil
  modified_base (9)..(9): 2'O-Methyl-uracil
  modified_base (14)..(14): 2'O-Methyl-uracil
  modified_base (15)..(15): 2'O-Methyl-cytosine
  modified_base (19)..(19): 2'O-Methyl-uracil
  misc_feature (20)..(21): Phosphorothioate linkage
uacccugaugagaucgagutt

SEQ ID NO: 789 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 2'O-Methyl-cytosine
  modified_base (7)..(7): 2'O-Methyl-uracil
  modified_base (12)..(12): 2'O-Methyl-uracil
  modified_base (18)..(18): 2'O-Methyl-uracil
  misc_feature (20)..(21): Phosphorothioate linkage
acucgaucucaucaggguatt

SEQ ID NO: 790 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (6)..(6): 2'O-Methyl-uracil
  modified_base (9)..(9): 2'O-Methyl-uracil
  misc_feature (20)..(21): Phosphorothioate linkage
uacccugaugagaucgagutt

SEQ ID NO: 791 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (10)..(10): 2'O-Methyl-cytosine
  modified_base (13)..(13): 2'O-Methyl-cytosine
  modified_base (18)..(18): 2'O-Methyl-uracil
  misc_feature (20)..(21): Phosphorothioate linkage
acucgaucucaucaggguatt

SEQ ID NO: 792 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 2'Fluoro-cytosine
  modified_base (3)..(3): 2'Fluoro-uracil
  modified_base (4)..(4): 2'Fluoro-cytosine
  modified_base (7)..(7): 2'Fluoro-uracil
  modified_base (8)..(8): 2'Fluoro-cytosine
  modified_base (9)..(9): 2'Fluoro-uracil
  modified_base (10)..(10): 2'Fluoro-cytosine
  modified_base (12)..(12): 2'Fluoro-uracil
  modified_base (13)..(13): 2'Fluoro-cytosine
  modified_base (18)..(18): 2'Fluoro-uracil
  misc_feature (20)..(21): Phosphorothioate linkage
acucgaucucaucaggguatt

SEQ ID NO: 793 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (10)..(10): 2'Fluoro-cytosine
  modified_base (13)..(13): 2'Fluoro-cytosine
  modified_base (18)..(18): 2'Fluoro-uracil
  misc_feature (20)..(21): Phosphorothioate linkage
acucgaucucaucaggguatt

SEQ ID NO: 794 - DNA, 21 bp, Artificial Sequence
  Description of Combined DNA/RNA molecule: Synthetic oligonucleotide
  Description of Artificial Sequence: Synthetic oligonucleotide
accaugcagauuaugcggatt

SEQ ID NO: 795 - DNA, 21 bp, Artificial Sequence
  Description of Combined DNA/RNA molecule: Synthetic oligonucleotide
  Description of Artificial Sequence: Synthetic oligonucleotide
uccgcauaaucugcauggutt

SEQ ID NO: 796 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 2'O-Methyl-cytosine
  misc_feature (2)..(3): Phosphorothioate linkage
  modified_base (4)..(4): 2'O-Methyl-adenine
  modified_base (6)..(6): 2'O-Methyl-guanine
  modified_base (8)..(8): 2'O-Methyl-adenine
  modified_base (10)..(10): 2'O-Methyl-adenine
  modified_base (12)..(12): 2'O-Methyl-uracil
  modified_base (14)..(14): 2'O-Methyl-uracil
  modified_base (16)..(16): 2'O-Methyl-cytosine
  modified_base (18)..(18): 2'O-Methyl-guanine
  misc_feature (18)..(19): Phosphorothioate linkage
  misc_feature (19)..(20): Phosphorothioate linkage
  misc_feature (20)..(21): Phosphorothioate linkage
accaugcagauuaugcggatt

SEQ ID NO: 797 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 2'O-Methyl-cytosine
  misc_feature (2)..(3): Phosphorothioate linkage
  modified_base (4)..(4): 2'O-Methyl-guanine
  modified_base (6)..(6): 2'O-Methyl-adenine
  modified_base (8)..(8): 2'O-Methyl-adenine
  modified_base (10)..(10): 2'O-Methyl-uracil
  modified_base (12)..(12): 2'O-Methyl-uracil
  modified_base (14)..(14): 2'O-Methyl-cytosine
  modified_base (16)..(16): 2'O-Methyl-uracil
  modified_base (18)..(18): 2'O-Methyl-guanine
  misc_feature (18)..(19): Phosphorothioate linkage
  misc_feature (19)..(20): Phosphorothioate linkage
  misc_feature (20)..(21): Phosphorothioate linkage
uccgcauaaucugcauggutt

SEQ ID NO: 798 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-adenine
  misc_feature (1)..(2): Phosphorothioate linkage
  misc_feature (2)..(3): Phosphorothioate linkage
  modified_base (3)..(3): 2'O-Methyl-cytosine
  modified_base (5)..(5): 2'O-Methyl-uracil
  modified_base (7)..(7): 2'O-Methyl-cytosine
  modified_base (9)..(9): 2'O-Methyl-guanine
  modified_base (11)..(11): 2'O-Methyl-uracil
  modified_base (13)..(13): 2'O-Methyl-adenine
  modified_base (15)..(15): 2'O-Methyl-guanine
  modified_base (17)..(17): 2'O-Methyl-guanine
  misc_feature (18)..(19): Phosphorothioate linkage
  modified_base (19)..(19): 2'O-Methyl-adenine
  misc_feature (19)..(20): Phosphorothioate linkage
  misc_feature (20)..(21): Phosphorothioate linkage
accaugcagauuaugcggatt

SEQ ID NO: 799 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-uracil
  misc_feature (1)..(2): Phosphorothioate linkage
  misc_feature (2)..(3): Phosphorothioate linkage
  modified_base (3)..(3): 2'O-Methyl-cytosine
  modified_base (5)..(5): 2'O-Methyl-cytosine
  modified_base (7)..(7): 2'O-Methyl-uracil
  modified_base (9)..(9): 2'O-Methyl-adenine
  modified_base (11)..(11): 2'O-Methyl-cytosine
  modified_base (13)..(13): 2'O-Methyl-guanine
  modified_base (15)..(15): 2'O-Methyl-adenine
  modified_base (17)..(17): 2'O-Methyl-guanine
  misc_feature (18)..(19): Phosphorothioate linkage
  modified_base (19)..(19): 2'O-Methyl-uracil
  misc_feature (19)..(20): Phosphorothioate linkage
  misc_feature (20)..(21): Phosphorothioate linkage
uccgcauaaucugcauggutt

SEQ ID NO: 800 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-adenine
  misc_feature (1)..(2): Phosphorothioate linkage
  modified_base (3)..(3): 2'O-Methyl-cytosine
  modified_base (5)..(5): 2'O-Methyl-uracil
  modified_base (7)..(7): 2'O-Methyl-cytosine
  modified_base (11)..(12): 2'O-Methyl-uracil
  modified_base (14)..(14): 2'O-Methyl-uracil
  modified_base (16)..(16): 2'O-Methyl-cytosine
  misc_feature (20)..(21): Phosphorothioate linkage
accaugcagauuaugcggatt

SEQ ID NO: 801 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-uracil
  misc_feature (1)..(2): Phosphorothioate linkage
  modified_base (2)..(3): 2'O-Methyl-cytosine
  modified_base (5)..(5): 2'O-Methyl-cytosine
  modified_base (7)..(7): 2'O-Methyl-uracil
  modified_base (10)..(10): 2'O-Methyl-uracil
  modified_base (11)..(11): 2'O-Methyl-cytosine
  modified_base (12)..(12): 2'O-Methyl-uracil
  modified_base (14)..(14): 2'O-Methyl-cytosine
  modified_base (16)..(16): 2'O-Methyl-uracil
  modified_base (19)..(19): 2'O-Methyl-uracil
  misc_feature (20)..(21): Phosphorothioate linkage
uccgcauaaucugcauggutt

SEQ ID NO: 802 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (3)..(3): 2'O-Methyl-cytosine
  modified_base (5)..(5): 2'O-Methyl-uracil
  modified_base (7)..(7): 2'O-Methyl-cytosine
  modified_base (12)..(12): 2'O-Methyl-uracil
  modified_base (14)..(14): 2'O-Methyl-uracil
  misc_feature (20)..(21): Phosphorothioate linkage
accaugcagauuaugcggatt

SEQ ID NO: 803 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (5)..(5): 2'O-Methyl-cytosine
  modified_base (7)..(7): 2'O-Methyl-uracil
  modified_base (12)..(12): 2'O-Methyl-uracil
  modified_base (14)..(14): 2'O-Methyl-cytosine
  modified_base (16)..(16): 2'O-Methyl-uracil
  misc_feature (20)..(21): Phosphorothioate linkage
uccgcauaaucugcauggutt

SEQ ID NO: 804 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'Fluoro-uracil
  misc_feature (1)..(2): Phosphorothioate linkage
  modified_base (2)..(3): 2'Fluoro-cytosine
  modified_base (5)..(5): 2'Fluoro-cytosine
  modified_base (6)..(6): 2'Fluoro-adenine
  modified_base (7)..(7): 2'Fluoro-uracil
  modified_base (10)..(10): 2'Fluoro-uracil
  modified_base (11)..(11): 2'Fluoro-cytosine
  modified_base (12)..(12): 2'Fluoro-uracil
  modified_base (14)..(14): 2'Fluoro-cytosine
  modified_base (16)..(16): 2'Fluoro-uracil
  modified_base (19)..(19): 2'Fluoro-uracil
  misc_feature (20)..(21): Phosphorothioate linkage
uccgcauaaucugcauggutt

SEQ ID NO: 805 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (5)..(5): 2'Fluoro-cytosine
  modified_base (7)..(7): 2'Fluoro-uracil
  modified_base (12)..(12): 2'Fluoro-uracil
  modified_base (14)..(14): 2'Fluoro-cytosine
  modified_base (16)..(16): 2'Fluoro-uracil
  misc_feature (20)..(21): Phosphorothioate linkage
uccgcauaaucugcauggutt

SEQ ID NO: 806 - DNA, 21 bp, Artificial Sequence
  Description of Combined DNA/RNA molecule: Synthetic oligonucleotide
  Description of Artificial Sequence: Synthetic oligonucleotide
gcggaucaaaccucaccaatt

SEQ ID NO: 807 - DNA, 21 bp, Artificial Sequence
  Description of Combined DNA/RNA molecule: Synthetic oligonucleotide
  Description of Artificial Sequence: Synthetic oligonucleotide
uuggugagguuugauccgctt

SEQ ID NO: 808 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 2'O-Methyl-cytosine
  misc_feature (2)..(3): Phosphorothioate linkage
  modified_base (4)..(4): 2'O-Methyl-guanine
  modified_base (6)..(6): 2'O-Methyl-uracil
  modified_base (8)..(8): 2'O-Methyl-adenine
  modified_base (10)..(10): 2'O-Methyl-adenine
  modified_base (12)..(12): 2'O-Methyl-cytosine
  modified_base (14)..(14): 2'O-Methyl-cytosine
  modified_base (16)..(16): 2'O-Methyl-cytosine
  modified_base (18)..(18): 2'O-Methyl-adenine
  misc_feature (18)..(19): Phosphorothioate linkage
  misc_feature (19)..(20): Phosphorothioate linkage
  misc_feature (20)..(21): Phosphorothioate linkage
gcggaucaaaccucaccaatt

SEQ ID NO: 809 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 2'O-Methyl-uracil
  misc_feature (2)..(3): Phosphorothioate linkage
  modified_base (4)..(4): 2'O-Methyl-guanine
  modified_base (6)..(6): 2'O-Methyl-guanine
  modified_base (8)..(8): 2'O-Methyl-guanine
  modified_base (10)..(10): 2'O-Methyl-uracil
  modified_base (12)..(12): 2'O-Methyl-uracil
  modified_base (14)..(14): 2'O-Methyl-adenine
  modified_base (16)..(16): 2'O-Methyl-cytosine
  modified_base (18)..(18): 2'O-Methyl-guanine
  misc_feature (18)..(19): Phosphorothioate linkage
  misc_feature (19)..(20): Phosphorothioate linkage
  misc_feature (20)..(21): Phosphorothioate linkage
uuggugagguuugauccgctt

SEQ ID NO: 810 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-guanine
  misc_feature (1)..(2): Phosphorothioate linkage
  misc_feature (2)..(3): Phosphorothioate linkage
  modified_base (3)..(3): 2'O-Methyl-guanine
  modified_base (5)..(5): 2'O-Methyl-adenine
  modified_base (7)..(7): 2'O-Methyl-cytosine
  modified_base (9)..(9): 2'O-Methyl-adenine
  modified_base (11)..(11): 2'O-Methyl-cytosine
  modified_base (13)..(13): 2'O-Methyl-uracil
  modified_base (15)..(15): 2'O-Methyl-adenine
  modified_base (17)..(17): 2'O-Methyl-cytosine
  misc_feature (18)..(19): Phosphorothioate linkage
  modified_base (19)..(19): 2'O-Methyl-adenine
  misc_feature (19)..(20): Phosphorothioate linkage
  misc_feature (20)..(21): Phosphorothioate linkage
gcggaucaaaccucaccaatt

SEQ ID NO: 811 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-uracil
  misc_feature (1)..(2): Phosphorothioate linkage
  misc_feature (2)..(3): Phosphorothioate linkage
  modified_base (3)..(3): 2'O-Methyl-guanine
  modified_base (5)..(5): 2'O-Methyl-uracil
  modified_base (7)..(7): 2'O-Methyl-adenine
  modified_base (9)..(9): 2'O-Methyl-guanine
  modified_base (11)..(11): 2'O-Methyl-uracil
  modified_base (13)..(13): 2'O-Methyl-guanine
  modified_base (15)..(15): 2'O-Methyl-uracil
  modified_base (17)..(17): 2'O-Methyl-cytosine
  misc_feature (18)..(19): Phosphorothioate linkage
  modified_base (19)..(19): 2'O-Methyl-cytosine
  misc_feature (19)..(20): Phosphorothioate linkage
  misc_feature (20)..(21): Phosphorothioate linkage
uuggugagguuugauccgctt

SEQ ID NO: 812 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-guanine
  misc_feature (1)..(2): Phosphorothioate linkage
  modified_base (2)..(2): 2'O-Methyl-cytosine
  modified_base (6)..(6): 2'O-Methyl-uracil
  modified_base (7)..(7): 2'O-Methyl-cytosine
  modified_base (11)..(12): 2'O-Methyl-cytosine
  modified_base (13)..(13): 2'O-Methyl-uracil
  modified_base (14)..(14): 2'O-Methyl-cytosine
  modified_base (16)..(17): 2'O-Methyl-cytosine
  misc_feature (20)..(21): Phosphorothioate linkage
gcggaucaaaccucaccaatt

SEQ ID NO: 813 - DNA, 21 bp, Artificial Sequence
  Description of Combined DNA/RNA molecule: Synthetic oligonucleotide
  Description of Artificial Sequence: Synthetic oligonucleotide
  modified_base (1)..(2): 2'O-Methyl-uracil
  misc_feature (1)..(2): Phosphorothioate linkage
  modified_base (5)..(5): 2'O-Methyl-uracil
  modified_base (10)..(12): 2'O-Methyl-uracil
  modified_base (15)..(15): 2'O-Methyl-uracil
  modified_base (16)..(17): 2'O-Methyl-cytosine
  modified_base (19)..(19): 2'O-Methyl-cytosine
  misc_feature (20)..(21): Phosphorothioate linkage
uuggugagguuugauccgctt

SEQ ID NO: 814 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (7)..(7): 2'O-Methyl-cytosine
  modified_base (14)..(14): 2'O-Methyl-cytosine
  modified_base (17)..(17): 2'O-Methyl-cytosine
  misc_feature (20)..(21): Phosphorothioate linkage
gcggaucaaaccucaccaatt

SEQ ID NO: 815 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 2'O-Methyl-uracil
  modified_base (5)..(5): 2'O-Methyl-uracil
  modified_base (12)..(12): 2'O-Methyl-uracil
  misc_feature (20)..(21): Phosphorothioate linkage
uuggugagguuugauccgctt

SEQ ID NO: 816 - DNA, 21 bp, Artificial Sequence
  Description of Combined DNA/RNA molecule: Synthetic oligonucleotide
  Description of Artificial Sequence: Synthetic oligonucleotide
  modified_base (1)..(2): 2'Fluoro-uracil
  misc_feature (1)..(2): Phosphorothioate linkage
  modified_base (5)..(5): 2'Fluoro-uracil
  modified_base (10)..(12): 2'Fluoro-uracil
  modified_base (15)..(15): 2'O-Methyl-uracil
  modified_base (16)..(17): 2'Fluoro-cytosine
  modified_base (19)..(19): 2'Fluoro-cytosine
  misc_feature (20)..(21): Phosphorothioate linkage
uuggugagguuugauccgctt

SEQ ID NO: 817 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 2'Fluoro-uracil
  modified_base (5)..(5): 2'Fluoro-uracil
  modified_base (12)..(12): 2'Fluoro-uracil
  misc_feature (20)..(21): Phosphorothioate linkage
uuggugagguuugauccgctt

SEQ ID NO: 818 - DNA, 21 bp, Artificial Sequence
  Description of Combined DNA/RNA molecule: Synthetic oligonucleotide
  Description of Artificial Sequence: Synthetic oligonucleotide
accucaccaaggccagcactt

SEQ ID NO: 819 - DNA, 21 bp, Artificial Sequence
  Description of Combined DNA/RNA molecule: Synthetic oligonucleotide
  Description of Artificial Sequence: Synthetic oligonucleotide
gugcuggccuuggugaggutt

SEQ ID NO: 820 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 2'O-Methyl-cytosine
  misc_feature (2)..(3): Phosphorothioate linkage
  modified_base (4)..(4): 2'O-Methyl-uracil
  modified_base (6)..(6): 2'O-Methyl-adenine
  modified_base (8)..(8): 2'O-Methyl-cytosine
  modified_base (10)..(10): 2'O-Methyl-adenine
  modified_base (12)..(12): 2'O-Methyl-guanine
  modified_base (14)..(14): 2'O-Methyl-cytosine
  modified_base (16)..(16): 2'O-Methyl-guanine
  modified_base (18)..(18): 2'O-Methyl-adenine
  misc_feature (18)..(19): Phosphorothioate linkage
  misc_feature (19)..(20): Phosphorothioate linkage
  misc_feature (20)..(21): Phosphorothioate linkage
accucaccaaggccagcactt

SEQ ID NO: 821 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 2'O-Methyl-uracil
  misc_feature (2)..(3): Phosphorothioate linkage
  modified_base (4)..(4): 2'O-Methyl-cytosine
  modified_base (6)..(6): 2'O-Methyl-guanine
  modified_base (8)..(8): 2'O-Methyl-cytosine
  modified_base (10)..(10): 2'O-Methyl-uracil
  modified_base (12)..(12): 2'O-Methyl-guanine
  modified_base (14)..(14): 2'O-Methyl-uracil
  modified_base (16)..(16): 2'O-Methyl-adenine
  modified_base (18)..(18): 2'O-Methyl-guanine
  misc_feature (18)..(19): Phosphorothioate linkage
  misc_feature (19)..(20): Phosphorothioate linkage
  misc_feature (20)..(21): Phosphorothioate linkage
gugcuggccuuggugaggutt

SEQ ID NO: 822 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-adenine
  misc_feature (1)..(2): Phosphorothioate linkage
  misc_feature (2)..(3): Phosphorothioate linkage
  modified_base (3)..(3): 2'O-Methyl-cytosine
  modified_base (5)..(5): 2'O-Methyl-cytosine
  modified_base (7)..(7): 2'O-Methyl-cytosine
  modified_base (9)..(9): 2'O-Methyl-adenine
  modified_base (11)..(11): 2'O-Methyl-guanine
  modified_base (13)..(13): 2'O-Methyl-cytosine
  modified_base (15)..(15): 2'O-Methyl-adenine
  modified_base (17)..(17): 2'O-Methyl-cytosine
  misc_feature (18)..(19): Phosphorothioate linkage
  modified_base (19)..(19): 2'O-Methyl-cytosine
  misc_feature (19)..(20): Phosphorothioate linkage
  misc_feature (20)..(21): Phosphorothioate linkage
accucaccaaggccagcactt

SEQ ID NO: 823 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-guanine
  misc_feature (1)..(2): Phosphorothioate linkage
  misc_feature (2)..(3): Phosphorothioate linkage
  modified_base (3)..(3): 2'O-Methyl-guanine
  modified_base (5)..(5): 2'O-Methyl-uracil
  modified_base (7)..(7): 2'O-Methyl-guanine
  modified_base (9)..(9): 2'O-Methyl-cytosine
  modified_base (11)..(11): 2'O-Methyl-uracil
  modified_base (13)..(13): 2'O-Methyl-guanine
  modified_base (15)..(15): 2'O-Methyl-guanine
  modified_base (17)..(17): 2'O-Methyl-guanine
  misc_feature (18)..(19): Phosphorothioate linkage
  modified_base (19)..(19): 2'O-Methyl-uracil
  misc_feature (19)..(20): Phosphorothioate linkage
  misc_feature (20)..(21): Phosphorothioate linkage
gugcuggccuuggugaggutt

SEQ ID NO: 824 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-adenine
  misc_feature (1)..(2): Phosphorothioate linkage
  modified_base (2)..(3): 2'O-Methyl-cytosine
  modified_base (4)..(4): 2'O-Methyl-uracil
  modified_base (5)..(5): 2'O-Methyl-cytosine
  modified_base (7)..(8): 2'O-Methyl-cytosine
  modified_base (13)..(14): 2'O-Methyl-cytosine
  modified_base (17)..(17): 2'O-Methyl-cytosine
  modified_base (19)..(19): 2'O-Methyl-cytosine
  misc_feature (20)..(21): Phosphorothioate linkage
accucaccaaggccagcactt

SEQ ID NO: 825 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-guanine
  misc_feature (1)..(2): Phosphorothioate linkage
  modified_base (2)..(2): 2'O-Methyl-uracil
  modified_base (4)..(4): 2'O-Methyl-cytosine
  modified_base (5)..(5): 2'O-Methyl-uracil
  modified_base (8)..(9): 2'O-Methyl-cytosine
  modified_base (10)..(11): 2'O-Methyl-uracil
  modified_base (14)..(14): 2'O-Methyl-uracil
  modified_base (19)..(19): 2'O-Methyl-uracil
  misc_feature (20)..(21): Phosphorothioate linkage
gugcuggccuuggugaggutt

SEQ ID NO: 826 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (5)..(5): 2'O-Methyl-cytosine
  modified_base (8)..(8): 2'O-Methyl-cytosine
  modified_base (14)..(14): 2'O-Methyl-cytosine
  modified_base (17)..(17): 2'O-Methyl-cytosine
  misc_feature (20)..(21): Phosphorothioate linkage
accucaccaaggccagcactt

SEQ ID NO: 827 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 2'O-Methyl-uracil
  modified_base (5)..(5): 2'O-Methyl-uracil
  modified_base (11)..(11): 2'O-Methyl-uracil
  modified_base (14)..(14): 2'O-Methyl-uracil
  misc_feature (20)..(21): Phosphorothioate linkage
gugcuggccuuggugaggutt

SEQ ID NO: 828 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-guanine
  misc_feature (1)..(2): Phosphorothioate linkage
  modified_base (2)..(2): 2'Fluoro-uracil
  modified_base (4)..(4): 2'Fluoro-cytosine
  modified_base (5)..(5): 2'Fluoro-uracil
  modified_base (8)..(9): 2'Fluoro-cytosine
  modified_base (10)..(11): 2'Fluoro-uracil
  modified_base (14)..(14): 2'Fluoro-uracil
  modified_base (19)..(19): 2'Fluoro-uracil
  misc_feature (20)..(21): Phosphorothioate linkage
gugcuggccuuggugaggutt

SEQ ID NO: 829 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 2'Fluoro-uracil
  modified_base (5)..(5): 2'Fluoro-uracil
  modified_base (11)..(11): 2'Fluoro-uracil
  modified_base (14)..(14): 2'Fluoro-uracil
  misc_feature (20)..(21): Phosphorothioate linkage
gugcuggccuuggugaggutt

SEQ ID NO: 830 - RNA, 21 nt, Artificial Sequence
  Description of Artificial Sequence: Synthetic oligonucleotide
gaacugugugugagagguccu

SEQ ID NO: 831 - RNA, 23 nt, Artificial Sequence
  Description of Artificial Sequence: Synthetic oligonucleotide
aggaccucucacacacaguucgc

SEQ ID NO: 832 - RNA, 21 nt, Artificial Sequence
  Description of Artificial Sequence: Synthetic oligonucleotide
  misc_feature (1)..(2): Phosphorothioate linkage
  modified_base (2)..(2): 2'O-Methyl-cytosine
  misc_feature (2)..(3): Phosphorothioate linkage
  modified_base (4)..(4): 2'O-Methyl-cytosine
  modified_base (6)..(6): 2'O-Methyl-uracil
  modified_base (8)..(8): 2'O-Methyl-guanine
  modified_base (10)..(10): 2'O-Methyl-adenine
  modified_base (12)..(12): 2'O-Methyl-adenine
  modified_base (14)..(14): 2'O-Methyl-adenine
  modified_base (16)..(16): 2'O-Methyl-guanine
  modified_base (18)..(18): 2'O-Methyl-guanine
  misc_feature (18)..(19): Phosphorothioate linkage
  misc_feature (19)..(20): Phosphorothioate linkage
  modified_base (20)..(20): 2'O-Methyl-uracil
  misc_feature (20)..(21): Phosphorothioate linkage
gcacauaggagagaugagcuu

SEQ ID NO: 833 - RNA, 23 nt, Artificial Sequence
  Description of Artificial Sequence: Synthetic oligonucleotide
  misc_feature (1)..(2): Phosphorothioate linkage
  modified_base (2)..(2): 2'O-Methyl-adenine
  misc_feature (2)..(3): Phosphorothioate linkage
  modified_base (4)..(4): 2'O-Methyl-cytosine
  modified_base (6)..(6): 2'O-Methyl-cytosine
  modified_base (8)..(8): 2'O-Methyl-uracil
  modified_base (10)..(10): 2'O-Methyl-uracil
  modified_base (12)..(12): 2'O-Methyl-uracil
  modified_base (14)..(14): 2'O-Methyl-cytosine
  modified_base (16)..(16): 2'O-Methyl-adenine
  modified_base (18)..(18): 2'O-Methyl-guanine
  modified_base (20)..(20): 2'O-Methyl-guanine
  misc_feature (20)..(21): Phosphorothioate linkage
  misc_feature (21)..(22): Phosphorothioate linkage
  modified_base (22)..(22): 2'O-Methyl-uracil
  misc_feature (22)..(23): Phosphorothioate linkage
aagcucaucucuccuaugugcug

SEQ ID NO: 834 - RNA, 21 nt, Artificial Sequence
  Description of Artificial Sequence: Synthetic oligonucleotide
  modified_base (1)..(1): 2'O-Methyl-guanine
  misc_feature (1)..(2): Phosphorothioate linkage
  misc_feature (2)..(3): Phosphorothioate linkage
  modified_base (3)..(3): 2'O-Methyl-adenine
  modified_base (5)..(5): 2'O-Methyl-adenine
  modified_base (7)..(7): 2'O-Methyl-adenine
  modified_base (9)..(9): 2'O-Methyl-guanine
  modified_base (11)..(11): 2'O-Methyl-guanine
  modified_base (13)..(13): 2'O-Methyl-guanine
  modified_base (15)..(15): 2'O-Methyl-uracil
  modified_base (17)..(17): 2'O-Methyl-adenine
  misc_feature (18)..(19): Phosphorothioate linkage
  modified_base (19)..(19): 2'O-Methyl-cytosine
  misc_feature (19)..(20): Phosphorothioate linkage
  misc_feature (20)..(21): Phosphorothioate linkage
  modified_base (21)..(21): 2'O-Methyl-uracil
gcacauaggagagaugagcuu

SEQ ID NO: 835 - RNA, 21 nt, Artificial Sequence
  Description of Artificial Sequence: Synthetic oligonucleotide
  modified_base (1)..(1): 2'O-Methyl-adenine
  misc_feature (1)..(2): Phosphorothioate linkage
  misc_feature (2)..(3): Phosphorothioate linkage
  modified_base (3)..(3): 2'O-Methyl-guanine
  modified_base (5)..(5): 2'O-Methyl-uracil
  modified_base (7)..(7): 2'O-Methyl-adenine
  modified_base (9)..(9): 2'O-Methyl-cytosine
  modified_base (11)..(11): 2'O-Methyl-cytosine
  modified_base (13)..(13): 2'O-Methyl-cytosine
  modified_base (15)..(15): 2'O-Methyl-uracil
  modified_base (17)..(17): 2'O-Methyl-uracil
  misc_feature (18)..(19): Phosphorothioate linkage
  modified_base (19)..(19): 2'O-Methyl-uracil
  misc_feature (19)..(20): Phosphorothioate linkage
  misc_feature (20)..(21): Phosphorothioate linkage
  modified_base (21)..(21): 2'O-Methyl-cytosine
aagcucaucucuccuaugugc

SEQ ID NO: 836 - RNA, 21 nt, Artificial Sequence
  Description of Artificial Sequence: Synthetic oligonucleotide
  misc_feature (1)..(2): Phosphorothioate linkage
  modified_base (2)..(2): 2'O-Methyl-cytosine
  modified_base (4)..(4): 2'O-Methyl-cytosine
  modified_base (6)..(6): 2'O-Methyl-uracil
  modified_base (15)..(15): 2'O-Methyl-uracil
  modified_base (19)..(19): 2'O-Methyl-cytosine
  modified_base (20)..(21): 2'O-Methyl-uracil
  misc_feature (20)..(21): Phosphorothioate linkage
gcacauaggagagaugagcuu

SEQ ID NO: 837 - RNA, 23 nt, Artificial Sequence
  Description of Artificial Sequence: Synthetic oligonucleotide
  misc_feature (1)..(2): Phosphorothioate linkage
  modified_base (4)..(4): 2'O-Methyl-cytosine
  modified_base (5)..(5): 2'O-Methyl-uracil
  modified_base (6)..(6): 2'O-Methyl-cytosine
  modified_base (8)..(8): 2'O-Methyl-uracil
  modified_base (9)..(9): 2'O-Methyl-cytosine
  modified_base (10)..(10): 2'O-Methyl-uracil
  modified_base (11)..(11): 2'O-Methyl-cytosine
  modified_base (12)..(12): 2'O-Methyl-uracil
  modified_base (13)..(14): 2'O-Methyl-cytosine
  modified_base (15)..(15): 2'O-Methyl-uracil
  modified_base (17)..(17): 2'O-Methyl-uracil
  modified_base (19)..(19): 2'O-Methyl-uracil
  modified_base (21)..(21): 2'O-Methyl-cytosine
  modified_base (22)..(22): 2'O-Methyl-uracil
  misc_feature (22)..(23): Phosphorothioate linkage
aagcucaucucuccuaugugcug

SEQ ID NO: 838 - RNA, 21 nt, Artificial Sequence
  Description of Artificial Sequence: Synthetic oligonucleotide
  misc_feature (1)..(2): Phosphorothioate linkage
  modified_base (2)..(2): 2'O-Methyl-cytosine
  modified_base (4)..(4): 2'O-Methyl-cytosine
  modified_base (6)..(6): 2'O-Methyl-uracil
  modified_base (15)..(15): 2'O-Methyl-uracil
  misc_feature (20)..(21): Phosphorothioate linkage
gcacauaggagagaugagcuu

SEQ ID NO: 839 - RNA, 23 nt, Artificial Sequence
  Description of Artificial Sequence: Synthetic oligonucleotide
  misc_feature (1)..(2): Phosphorothioate linkage
  modified_base (6)..(6): 2'O-Methyl-cytosine
  modified_base (15)..(15): 2'O-Methyl-uracil
  modified_base (17)..(17): 2'O-Methyl-uracil
  modified_base (19)..(19): 2'O-Methyl-uracil
  modified_base (22)..(22): 2'O-Methyl-uracil
  misc_feature (22)..(23): Phosphorothioate linkage
aagcucaucucuccuaugugcug

SEQ ID NO: 840 - RNA, 23 nt, Artificial Sequence
  Description of Artificial Sequence: Synthetic oligonucleotide
  misc_feature (1)..(2): Phosphorothioate linkage
  modified_base (4)..(4): 2'Fluoro-cytosine
  modified_base (5)..(5): 2'Fluoro-uracil
  modified_base (6)..(6): 2'Fluoro-cytosine
  modified_base (8)..(8): 2'Fluoro-uracil
  modified_base (9)..(9): 2'Fluoro-cytosine
  modified_base (10)..(10): 2'Fluoro-uracil
  modified_base (11)..(11): 2'Fluoro-cytosine
  modified_base (12)..(12): 2'Fluoro-uracil
  modified_base (13)..(14): 2'Fluoro-cytosine
  modified_base (15)..(15): 2'Fluoro-uracil
  modified_base (17)..(17): 2'Fluoro-uracil
  modified_base (19)..(19): 2'Fluoro-uracil
  modified_base (21)..(21): 2'Fluoro-cytosine
  modified_base (22)..(22): 2'Fluoro-uracil
  misc_feature (22)..(23): Phosphorothioate linkage
aagcucaucucuccuaugugcug

SEQ ID NO: 841 - RNA, 23 nt, Artificial Sequence
  Description of Artificial Sequence: Synthetic oligonucleotide
  misc_feature (1)..(2): Phosphorothioate linkage
  modified_base (6)..(6): 2'Fluoro-cytosine
  modified_base (15)..(15): 2'Fluoro-uracil
  modified_base (17)..(17): 2'Fluoro-uracil
  modified_base (19)..(19): 2'Fluoro-uracil
  modified_base (22)..(22): 2'Fluoro-uracil
  misc_feature (22)..(23): Phosphorothioate linkage
aagcucaucucuccuaugugcug

SEQ ID NO: 842 - DNA, 21 bp, Artificial Sequence
  Description of Combined DNA/RNA molecule: Synthetic oligonucleotide
  Description of Artificial Sequence: Synthetic oligonucleotide
gcacauaggagagaugagctt

SEQ ID NO: 843 - DNA, 21 bp, Artificial Sequence
  Description of Combined DNA/RNA molecule: Synthetic oligonucleotide
  Description of Artificial Sequence: Synthetic oligonucleotide
gcucaucucuccuaugugctt

SEQ ID NO: 844 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 2'O-Methyl-cytosine
  misc_feature (2)..(3): Phosphorothioate linkage
  modified_base (4)..(4): 2'O-Methyl-cytosine
  modified_base (6)..(6): 2'O-Methyl-uracil
  modified_base (8)..(8): 2'O-Methyl-guanine
  modified_base (10)..(10): 2'O-Methyl-adenine
  modified_base (12)..(12): 2'O-Methyl-adenine
  modified_base (14)..(14): 2'O-Methyl-adenine
  modified_base (16)..(16): 2'O-Methyl-guanine
  modified_base (18)..(18): 2'O-Methyl-guanine
  misc_feature (18)..(19): Phosphorothioate linkage
  misc_feature (19)..(20): Phosphorothioate linkage
  misc_feature (20)..(21): Phosphorothioate linkage
gcacauaggagagaugagctt

SEQ ID NO: 845 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 2'O-Methyl-cytosine
  misc_feature (2)..(3): Phosphorothioate linkage
  modified_base (4)..(4): 2'O-Methyl-cytosine
  modified_base (6)..(6): 2'O-Methyl-uracil
  modified_base (8)..(8): 2'O-Methyl-uracil
  modified_base (10)..(10): 2'O-Methyl-uracil
  modified_base (12)..(12): 2'O-Methyl-cytosine
  modified_base (14)..(14): 2'O-Methyl-adenine
  modified_base (16)..(16): 2'O-Methyl-guanine
  modified_base (18)..(18): 2'O-Methyl-guanine
  misc_feature (18)..(19): Phosphorothioate linkage
  misc_feature (19)..(20): Phosphorothioate linkage
  misc_feature (20)..(21): Phosphorothioate linkage
gcucaucucuccuaugugctt

SEQ ID NO: 846 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-guanine
  misc_feature (1)..(2): Phosphorothioate linkage
  misc_feature (2)..(3): Phosphorothioate linkage
  modified_base (3)..(3): 2'O-Methyl-adenine
  modified_base (5)..(5): 2'O-Methyl-adenine
  modified_base (7)..(7): 2'O-Methyl-adenine
  modified_base (9)..(9): 2'O-Methyl-guanine
  modified_base (11)..(11): 2'O-Methyl-guanine
  modified_base (13)..(13): 2'O-Methyl-guanine
  modified_base (15)..(15): 2'O-Methyl-uracil
  modified_base (17)..(17): 2'O-Methyl-adenine
  misc_feature (18)..(19): Phosphorothioate linkage
  modified_base (19)..(19): 2'O-Methyl-cytosine
  misc_feature (19)..(20): Phosphorothioate linkage
  misc_feature (20)..(21): Phosphorothioate linkage
gcacauaggagagaugagctt

SEQ ID NO: 847 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-guanine
  misc_feature (1)..(2): Phosphorothioate linkage
  misc_feature (2)..(3): Phosphorothioate linkage
  modified_base (3)..(3): 2'O-Methyl-uracil
  modified_base (5)..(5): 2'O-Methyl-adenine
  modified_base (7)..(7): 2'O-Methyl-cytosine
  modified_base (9)..(9): 2'O-Methyl-cytosine
  modified_base (11)..(11): 2'O-Methyl-cytosine
  modified_base (13)..(13): 2'O-Methyl-uracil
  modified_base (15)..(15): 2'O-Methyl-uracil
  modified_base (17)..(17): 2'O-Methyl-uracil
  misc_feature (18)..(19): Phosphorothioate linkage
  modified_base (19)..(19): 2'O-Methyl-cytosine
  misc_feature (19)..(20): Phosphorothioate linkage
  misc_feature (20)..(21): Phosphorothioate linkage
gcucaucucuccuaugugctt

SEQ ID NO: 848 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-guanine
  misc_feature (1)..(2): Phosphorothioate linkage
  modified_base (2)..(2): 2'O-Methyl-cytosine
  modified_base (4)..(4): 2'O-Methyl-cytosine
  modified_base (6)..(6): 2'O-Methyl-uracil
  modified_base (15)..(15): 2'O-Methyl-uracil
  modified_base (19)..(19): 2'O-Methyl-cytosine
  misc_feature (20)..(21): Phosphorothioate linkage
gcacauaggagagaugagctt

SEQ ID NO: 849 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 2'O-Methyl-cytosine
  modified_base (3)..(3): 2'O-Methyl-uracil
  modified_base (4)..(4): 2'O-Methyl-cytosine
  modified_base (6)..(6): 2'O-Methyl-uracil
  modified_base (7)..(7): 2'O-Methyl-cytosine
  modified_base (8)..(8): 2'O-Methyl-uracil
  modified_base (9)..(9): 2'O-Methyl-cytosine
  modified_base (10)..(10): 2'O-Methyl-uracil
  modified_base (11)..(12): 2'O-Methyl-cytosine
  modified_base (13)..(13): 2'O-Methyl-uracil
  modified_base (15)..(15): 2'O-Methyl-uracil
  modified_base (17)..(17): 2'O-Methyl-uracil
  modified_base (19)..19): 2'O-Methyl-cytosine
  misc_feature (20)..(21): Phosphorothioate linkage
gcucaucucuccuaugugctt

SEQ ID NO: 850 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 2'O-Methyl-cytosine
  modified_base (4)..(4): 2'O-Methyl-cytosine
  modified_base (6)..(6): 2'O-Methyl-uracil
  modified_base (15)..(15): 2'O-Methyl-uracil
  misc_feature (20)..(21): Phosphorothioate linkage
gcacauaggagagaugagctt

SEQ ID NO: 851 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (4)..(4): 2'O-Methyl-cytosine
  modified_base (13)..(13): 2'O-Methyl-uracil
  modified_base (15)..(15): 2'O-Methyl-uracil
  modified_base (17)..(17): 2'O-Methyl-uracil
  misc_feature (20)..(21): Phosphorothioate linkage
gcucaucucuccuaugugctt

SEQ ID NO: 852 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 2'Fluoro-cytosine
  modified_base (3)..(3): 2'Fluoro-uracil
  modified_base (4)..(4): 2'Fluoro-cytosine
  modified_base (6)..(6): 2'Fluoro-uracil
  modified_base (7)..(7): 2'Fluoro-cytosine
  modified_base (8)..(8): 2'Fluoro-uracil
  modified_base (9)..(9): 2'Fluoro-cytosine
  modified_base (10)..(10): 2'Fluoro-uracil
  modified_base (11)..(12): 2'Fluoro-cytosine
  modified_base (13)..(13): 2'Fluoro-uracil
  modified_base (15)..(15): 2'Fluoro-uracil
  modified_base (17)..(17): 2'Fluoro-uracil
  modified_base (19)..(19): 2'Fluoro-cytosine
  misc_feature (20)..(21): Phosphorothioate linkage
gcucaucucuccuaugugctt

SEQ ID NO: 853 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (4)..(4): 2'Fluoro-cytosine
  modified_base (13)..(13): 2'Fluoro-uracil
  modified_base (15)..(15): 2'Fluoro-uracil
  modified_base (17)..(17): 2'Fluoro-uracil
  misc_feature (20)..(21): Phosphorothioate linkage
gcucaucucuccuaugugctt

SEQ ID NO: 854 - DNA, 21 bp, Artificial Sequence
  Description of Combined DNA/RNA molecule: Synthetic oligonucleotide
  Description of Artificial Sequence: Synthetic oligonucleotide
cauaggagagaugagcuuctt

SEQ ID NO: 855 - DNA, 21 bp, Artificial Sequence
  Description of Combined DNA/RNA molecule: Synthetic oligonucleotide
  Description of Artificial Sequence: Synthetic oligonucleotide
gaagcucaucucuccuaugtt

SEQ ID NO: 856 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 2'O-Methyl-adenine
  misc_feature (2)..(3): Phosphorothioate linkage
  modified_base (4)..(4): 2'O-Methyl-adenine
  modified_base (6)..(6): 2'O-Methyl-guanine
  modified_base (8)..(8): 2'O-Methyl-guanine
  modified_base (10)..(10): 2'O-Methyl-guanine
  modified_base (12)..(12): 2'O-Methyl-uracil
  modified_base (14)..(14): 2'O-Methyl-adenine
  modified_base (16)..(16): 2'O-Methyl-cytosine
  modified_base (18)..(18): 2'O-Methyl-uracil
  misc_feature (18)..(19): Phosphorothioate linkage
  misc_feature (19)..(20): Phosphorothioate linkage
  misc_feature (20)..(21): Phosphorothioate linkage
cauaggagagaugagcuuctt

SEQ ID NO: 857 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 2'O-Methyl-adenine
  misc_feature (2)..(3): Phosphorothioate linkage
  modified_base (4)..(4): 2'O-Methyl-guanine
  modified_base (6)..(6): 2'O-Methyl-uracil
  modified_base (8)..(8): 2'O-Methyl-adenine
  modified_base (10)..(10): 2'O-Methyl-cytosine
  modified_base (12)..(12): 2'O-Methyl-cytosine
  modified_base (14)..(14): 2'O-Methyl-cytosine
  modified_base (16)..(16): 2'O-Methyl-uracil
  modified_base (18)..(18): 2'O-Methyl-uracil
  misc_feature (18)..(19): Phosphorothioate linkage
  misc_feature (19)..(20): Phosphorothioate linkage
  misc_feature (20)..(21): Phosphorothioate linkage
gaagcucaucucuccuaugtt

SEQ ID NO: 858 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-cytosine
  misc_feature (1)..(2): Phosphorothioate linkage
  misc_feature (2)..(3): Phosphorothioate linkage
  modified_base (3)..(3): 2'O-Methyl-uracil
  modified_base (5)..(5): 2'O-Methyl-guanine
  modified_base (7)..(7): 2'O-Methyl-adenine
  modified_base (9)..(9): 2'O-Methyl-adenine
  modified_base (11)..(11): 2'O-Methyl-adenine
  modified_base (13)..(13): 2'O-Methyl-guanine
  modified_base (15)..(15): 2'O-Methyl-guanine
  modified_base (17)..(17): 2'O-Methyl-uracil
  misc_feature (18)..(19): Phosphorothioate linkage
  modified_base (19)..(19): 2'O-Methyl-cytosine
  misc_feature (19)..(20): Phosphorothioate linkage
  misc_feature (20)..(21): Phosphorothioate linkage
cauaggagagaugagcuuctt

SEQ ID NO: 859 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-guanine
  misc_feature (1)..(2): Phosphorothioate linkage
  misc_feature (2)..(3): Phosphorothioate linkage
  modified_base (3)..(3): 2'O-Methyl-adenine
  modified_base (5)..(5): 2'O-Methyl-cytosine
  modified_base (7)..(7): 2'O-Methyl-cytosine
  modified_base (9)..(9): 2'O-Methyl-uracil
  modified_base (11)..(11): 2'O-Methyl-uracil
  modified_base (13)..(13): 2'O-Methyl-uracil
  modified_base (15)..(15): 2'O-Methyl-cytosine
  modified_base (17)..(17): 2'O-Methyl-adenine
  misc_feature (18)..(19): Phosphorothioate linkage
  modified_base (19)..(19): 2'O-Methyl-guanine
  misc_feature (19)..(20): Phosphorothioate linkage
  misc_feature (20)..(21): Phosphorothioate linkage
gaagcucaucucuccuaugtt

SEQ ID NO: 860 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-cytosine
  misc_feature (1)..(2): Phosphorothioate linkage
  modified_base (3)..(3): 2'O-Methyl-uracil
  modified_base (12)..(12): 2'O-Methyl-uracil
  modified_base (16)..(16): 2'O-Methyl-cytosine
  modified_base (17)..(18): 2'O-Methyl-uracil
  modified_base (19)..(19): 2'O-Methyl-cytosine
  misc_feature (20)..(21): Phosphorothioate linkage
cauaggagagaugagcuuctt

SEQ ID NO: 861 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (5)..(5): 2'O-Methyl-cytosine
  modified_base (6)..(6): 2'O-Methyl-uracil
  modified_base (7)..(7): 2'O-Methyl-cytosine
  modified_base (9)..(9): 2'O-Methyl-uracil
  modified_base (10)..(10): 2'O-Methyl-cytosine
  modified_base (11)..(11): 2'O-Methyl-uracil
  modified_base (12)..(12): 2'O-Methyl-cytosine
  modified_base (13)..(13): 2'O-Methyl-uracil
  modified_base (14)..(15): 2'O-Methyl-cytosine
  modified_base (16)..(16): 2'O-Methyl-uracil
  modified_base (18)..(18): 2'O-Methyl-uracil
  misc_feature (20)..(21): Phosphorothioate linkage
gaagcucaucucuccuaugtt

SEQ ID NO: 862 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (3)..(3): 2'O-Methyl-uracil
  modified_base (12)..(12): 2'O-Methyl-uracil
  misc_feature (20)..(21): Phosphorothioate linkage
cauaggagagaugagcuuctt

SEQ ID NO: 863 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (7)..(7): 2'O-Methyl-cytosine
  modified_base (16)..(16): 2'O-Methyl-uracil
  modified_base (18)..(18): 2'O-Methyl-uracil
  misc_feature (20)..(21): Phosphorothioate linkage
gaagcucaucucuccuaugtt

SEQ ID NO: 864 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-cytosine
  misc_feature (1)..(2): Phosphorothioate linkage
  modified_base (3)..(3): 2'O-Methyl-uracil
  modified_base (12)..(12): 2'O-Methyl-uracil
  modified_base (16)..(16): 2'O-Methyl-cytosine
  modified_base (17)..(18): 2'O-Methyl-uracil
  modified_base (19)..(19): 2'O-Methyl-cytosine
  misc_feature (20)..(21): Phosphorothioate linkage
cauaggagagaugagcuuctt

SEQ ID NO: 865 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (5)..(5): 2'Fluoro-cytosine
  modified_base (6)..(6): 2'Fluoro-uracil
  modified_base (7)..(7): 2'Fluoro-cytosine
  modified_base (9)..(9): 2'Fluoro-uracil
  modified_base (10)..(10): 2'Fluoro-cytosine
  modified_base (11)..(11): 2'Fluoro-uracil
  modified_base (12)..(12): 2'Fluoro-cytosine
  modified_base (13)..(13): 2'Fluoro-uracil
  modified_base (14)..(15): 2'Fluoro-cytosine
  modified_base (16)..(16): 2'Fluoro-uracil
  modified_base (18)..(18): 2'Fluoro-uracil
  misc_feature (20)..(21): Phosphorothioate linkage
gaagcucaucucuccuaugtt

SEQ ID NO: 866 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (7)..(7): 2'Fluoro-cytosine
  modified_base (16)..(16): 2'Fluoro-uracil
  modified_base (18)..(18): 2'Fluoro-uracil
  misc_feature (20)..(21): Phosphorothioate linkage
gaagcucaucucuccuaugtt

SEQ ID NO: 867 - DNA, 21 bp, Artificial Sequence
  Description of Combined DNA/RNA molecule: Synthetic oligonucleotide
  Description of Artificial Sequence: Synthetic oligonucleotide
ugugaaugcagaccaaagatt

SEQ ID NO: 868 - DNA, 21 bp, Artificial Sequence
  Description of Combined DNA/RNA molecule: Synthetic oligonucleotide
  Description of Artificial Sequence: Synthetic oligonucleotide
ucuuuggucugcauucacatt

SEQ ID NO: 869 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 2'O-Methyl-guanine
  misc_feature (2)..(3): Phosphorothioate linkage
  modified_base (4)..(4): 2'O-Methyl-guanine
  modified_base (6)..(6): 2'O-Methyl-adenine
  modified_base (8)..(8): 2'O-Methyl-guanine
  modified_base (10)..(10): 2'O-Methyl-adenine
  modified_base (12)..(12): 2'O-Methyl-adenine
  modified_base (14)..(14): 2'O-Methyl-cytosine
  modified_base (16)..(16): 2'O-Methyl-adenine
  modified_base (18)..(18): 2'O-Methyl-guanine
  misc_feature (18)..(19): Phosphorothioate linkage
  misc_feature (19)..(20): Phosphorothioate linkage
  misc_feature (20)..(21): Phosphorothioate linkage
ugugaaugcagaccaaagatt

SEQ ID NO: 870 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 2'O-Methyl-cytosine
  misc_feature (2)..(3): Phosphorothioate linkage
  modified_base (4)..(4): 2'O-Methyl-uracil
  modified_base (6)..(6): 2'O-Methyl-guanine
  modified_base (8)..(8): 2'O-Methyl-uracil
  modified_base (10)..(10): 2'O-Methyl-uracil
  modified_base (12)..(12): 2'O-Methyl-cytosine
  modified_base (14)..(14): 2'O-Methyl-uracil
  modified_base (16)..(16): 2'O-Methyl-cytosine
  modified_base (18)..(18): 2'O-Methyl-cytosine
  misc_feature (18)..(19): Phosphorothioate linkage
  misc_feature (19)..(20): Phosphorothioate linkage
  misc_feature (20)..(21): Phosphorothioate linkage
ucuuuggucugcauucacatt

SEQ ID NO: 871 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-uracil
  misc_feature (1)..(2): Phosphorothioate linkage
  misc_feature (2)..(3): Phosphorothioate linkage
  modified_base (3)..(3): 2'O-Methyl-uracil
  modified_base (5)..(5): 2'O-Methyl-adenine
  modified_base (7)..(7): 2'O-Methyl-uracil
  modified_base (9)..(9): 2'O-Methyl-cytosine
  modified_base (11)..(11): 2'O-Methyl-guanine
  modified_base (13)..(13): 2'O-Methyl-cytosine
  modified_base (15)..(15): 2'O-Methyl-adenine
  modified_base (17)..(17): 2'O-Methyl-adenine
  misc_feature (18)..(19): Phosphorothioate linkage
  modified_base (19)..(19): 2'O-Methyl-adenine
  misc_feature (19)..(20): Phosphorothioate linkage
  misc_feature (20)..(21): Phosphorothioate linkage
ugugaaugcagaccaaagatt

SEQ ID NO: 872 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-uracil
  misc_feature (1)..(2): Phosphorothioate linkage
  misc_feature (2)..(3): Phosphorothioate linkage
  modified_base (3)..(3): 2'O-Methyl-uracil
  modified_base (5)..(5): 2'O-Methyl-uracil
  modified_base (7)..(7): 2'O-Methyl-guanine
  modified_base (9)..(9): 2'O-Methyl-cytosine
  modified_base (11)..(11): 2'O-Methyl-guanine
  modified_base (13)..(13): 2'O-Methyl-adenine
  modified_base (15)..(15): 2'O-Methyl-uracil
  modified_base (17)..(17): 2'O-Methyl-adenine
  misc_feature (18)..(19): Phosphorothioate linkage
  modified_base (19)..(19): 2'O-Methyl-adenine
  misc_feature (19)..(20): Phosphorothioate linkage
  misc_feature (20)..(21): Phosphorothioate linkage
ucuuuggucugcauucacatt

SEQ ID NO: 873 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-uracil
  misc_feature (1)..(2): Phosphorothioate linkage
  modified_base (3)..(3): 2'O-Methyl-uracil
  modified_base (7)..(7): 2'O-Methyl-uracil
  modified_base (9)..(9): 2'O-Methyl-cytosine
  modified_base (13)..(14): 2'O-Methyl-cytosine
  misc_feature (20)..(21): Phosphorothioate linkage
ugugaaugcagaccaaagatt

SEQ ID NO: 874 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-uracil
  misc_feature (1)..(2): Phosphorothioate linkage
  modified_base (2)..(2): 2'O-Methyl-cytosine
  modified_base (3)..(5): 2'O-Methyl-uracil
  modified_base (8)..(8): 2'O-Methyl-uracil
  modified_base (9)..(9): 2'O-Methyl-cytosine
  modified_base (10)..(10): 2'O-Methyl-uracil
  modified_base (12)..(12): 2'O-Methyl-cytosine
  modified_base (14)..(15): 2'O-Methyl-uracil
  modified_base (16)..(16): 2'O-Methyl-cytosine
  misc_feature (20)..(21): Phosphorothioate linkage
ucuuuggucugcauucacatt

SEQ ID NO: 875 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (3)..(3): 2'O-Methyl-uracil
  modified_base (7)..(7): 2'O-Methyl-uracil
  modified_base (9)..(9): 2'O-Methyl-cytosine
  modified_base (14)..(14): 2'O-Methyl-cytosine
  misc_feature (20)..(21): Phosphorothioate linkage
ugugaaugcagaccaaagatt

SEQ ID NO: 876 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (5)..(5): 2'O-Methyl-uracil
  modified_base (10)..(10): 2'O-Methyl-uracil
  modified_base (12)..(12): 2'O-Methyl-cytosine
  modified_base (16)..(16): 2'O-Methyl-cytosine
  modified_base (18)..(18): 2'O-Methyl-cytosine
  misc_feature (20)..(21): Phosphorothioate linkage
ucuuuggucugcauucacatt

SEQ ID NO: 877 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'Fluoro-uracil
  misc_feature (1)..(2): Phosphorothioate linkage
  modified_base (2)..(2): 2'Fluoro-cytosine
  modified_base (3)..(5): 2'Fluoro-uracil
  modified_base (8)..(8): 2'Fluoro-uracil
  modified_base (9)..(9): 2'Fluoro-cytosine
  modified_base (10)..(10): 2'Fluoro-uracil
  modified_base (12)..(12): 2'Fluoro-cytosine
  modified_base (14)..(15): 2'Fluoro-uracil
  modified_base (16)..(16): 2'Fluoro-cytosine
  modified_base (18)..(18): 2'Fluoro-cytosine
  misc_feature (20)..(21): Phosphorothioate linkage
ucuuuggucugcauucacatt

SEQ ID NO: 878 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (5)..(5): 2'Fluoro-uracil
  modified_base (10)..(10): 2'Fluoro-uracil
  modified_base (12)..(12): 2'Fluoro-cytosine
  modified_base (16)..(16): 2'Fluoro-cytosine
  modified_base (18)..(18): 2'Fluoro-cytosine
  misc_feature (20)..(21): Phosphorothioate linkage
ucuuuggucugcauucacatt

SEQ ID NO: 879 - RNA, 21 nt, Artificial Sequence
  Description of Artificial Sequence: Synthetic oligonucleotide
gugaaugcagaccaaagaaag

SEQ ID NO: 880 - RNA, 23 nt, Artificial Sequence
  Description of Artificial Sequence: Synthetic oligonucleotide
cuuucuuuggucugcauucacau

SEQ ID NO: 881 - RNA, 21 nt, Artificial Sequence
  Description of Artificial Sequence: Synthetic oligonucleotide
  misc_feature (1)..(2): Phosphorothioate linkage
  modified_base (2)..(2): 2'O-Methyl-uracil
  modified_base (4)..(4): 2'O-Methyl-adenine
  modified_base (6)..(6): 2'O-Methyl-uracil
  modified_base (8)..(8): 2'O-Methyl-cytosine
  modified_base (10)..(10): 2'O-Methyl-guanine
  modified_base (12)..(12): 2'O-Methyl-cytosine
  modified_base (14)..(14): 2'O-Methyl-adenine
  modified_base (16)..(16): 2'O-Methyl-adenine
  modified_base (18)..(18): 2'O-Methyl-adenine
  modified_base (20)..(20): 2'O-Methyl-adenine
  misc_feature (20)..(21): Phosphorothioate linkage
gugaaugcagaccaaagaaag

SEQ ID NO: 882 - RNA, 23 nt, Artificial Sequence
  Description of Artificial Sequence: Synthetic oligonucleotide
  misc_feature (1)..(2): Phosphorothioate linkage
  modified_base (2)..(2): 2'O-Methyl-uracil
  modified_base (4)..(4): 2'O-Methyl-uracil
  modified_base (6)..(6): 2'O-Methyl-uracil
  modified_base (8)..(8): 2'O-Methyl-uracil
  modified_base (10)..(10): 2'O-Methyl-guanine
  modified_base (12)..(12): 2'O-Methyl-cytosine
  modified_base (14)..(14): 2'O-Methyl-guanine
  modified_base (16)..(16): 2'O-Methyl-adenine
  modified_base (18)..(18): 2'O-Methyl-uracil
  modified_base (20)..(20): 2'O-Methyl-adenine
  modified_base (22)..(22): 2'O-Methyl-adenine
  misc_feature (22)..(23): Phosphorothioate linkage
cuuucuuuggucugcauucacau

SEQ ID NO: 883 - RNA, 21 nt, Artificial Sequence
  Description of Artificial Sequence: Synthetic oligonucleotide
  modified_base (1)..(1): 2'O-Methyl-guanine
  misc_feature (1)..(2): Phosphorothioate linkage
  modified_base (3)..(3): 2'O-Methyl-guanine
  modified_base (5)..(5): 2'O-Methyl-adenine
  modified_base (7)..(7): 2'O-Methyl-guanine
  modified_base (9)..(9): 2'O-Methyl-adenine
  modified_base (11)..(11): 2'O-Methyl-adenine
  modified_base (13)..(13): 2'O-Methyl-cytosine
  modified_base (15)..(15): 2'O-Methyl-adenine
  modified_base (17)..(17): 2'O-Methyl-guanine
  modified_base (19)..(19): 2'O-Methyl-adenine
  misc_feature (20)..(21): Phosphorothioate linkage
  modified_base (21)..(21): 2'O-Methyl-guanine
gugaaugcagaccaaagaaag

SEQ ID NO: 884 - RNA, 23 nt, Artificial Sequence
  Description of Artificial Sequence: Synthetic oligonucleotide
  modified_base (1)..(1): 2'O-Methyl-cytosine
  misc_feature (1)..(2): Phosphorothioate linkage
  modified_base (3)..(3): 2'O-Methyl-uracil
  modified_base (5)..(5): 2'O-Methyl-cytosine
  modified_base (7)..(7): 2'O-Methyl-uracil
  modified_base (9)..(9): 2'O-Methyl-guanine
  modified_base (11)..(11): 2'O-Methyl-uracil
  modified_base (13)..(13): 2'O-Methyl-uracil
  modified_base (15)..(15): 2'O-Methyl-cytosine
  modified_base (17)..(17): 2'O-Methyl-uracil
  modified_base (19)..(19): 2'O-Methyl-cytosine
  modified_base (21)..(21): 2'O-Methyl-cytosine
  misc_feature (22)..(23): Phosphorothioate linkage
  modified_base (23)..(23): 2'O-Methyl-uracil
cuuucuuuggucugcauucacau

SEQ ID NO: 885 - RNA, 21 nt, Artificial Sequence
  Description of Artificial Sequence: Synthetic oligonucleotide
  misc_feature (1)..(2): Phosphorothioate linkage
  modified_base (2)..(2): 2'O-Methyl-uracil
  modified_base (6)..(6): 2'O-Methyl-uracil
  modified_base (8)..(8): 2'O-Methyl-cytosine
  modified_base (12)..(13): 2'O-Methyl-cytosine
  misc_feature (20)..(21): Phosphorothioate linkage
gugaaugcagaccaaagaaag

SEQ ID NO: 886 - RNA, 23 nt, Artificial Sequence
  Description of Artificial Sequence: Synthetic oligonucleotide
  modified_base (1)..(1): 2'O-Methyl-cytosine
  misc_feature (1)..(2): Phosphorothioate linkage
  modified_base (2)..(4): 2'O-Methyl-uracil
  modified_base (5)..(5): 2'O-Methyl-cytosine
  modified_base (6)..(8): 2'O-Methyl-uracil
  modified_base (11)..(11): 2'O-Methyl-uracil
  modified_base (12)..(12): 2'O-Methyl-cytosine
  modified_base (13)..(13): 2'O-Methyl-uracil
  modified_base (15)..(15): 2'O-Methyl-cytosine
  modified_base (17)..(18): 2'O-Methyl-uracil
  modified_base (19)..(19): 2'O-Methyl-cytosine
  modified_base (21)..(21): 2'O-Methyl-cytosine
  misc_feature (22)..(23): Phosphorothioate linkage
  modified_base (23)..(23): 2'O-Methyl-uracil
cuuucuuuggucugcauucacau

SEQ ID NO: 887 - RNA, 21 nt, Artificial Sequence
  Description of Artificial Sequence: Synthetic oligonucleotide
  misc_feature (1)..(2): Phosphorothioate linkage
  modified_base (2)..(2): 2'O-Methyl-uracil
  modified_base (6)..(6): 2'O-Methyl-uracil
  modified_base (8)..(8): 2'O-Methyl-cytosine
  modified_base (13)..(13): 2'O-Methyl-cytosine
  misc_feature (20)..(21): Phosphorothioate linkage
gugaaugcagaccaaagaaag

SEQ ID NO: 888 - RNA, 23 nt, Artificial Sequence
  Description of Artificial Sequence: Synthetic oligonucleotide
  misc_feature (1)..(2): Phosphorothioate linkage
  modified_base (8)..(8): 2'O-Methyl-uracil
  modified_base (13)..(13): 2'O-Methyl-uracil
  modified_base (15)..(15): 2'O-Methyl-cytosine
  modified_base (19)..(19): 2'O-Methyl-cytosine
  misc_feature (22)..(23): Phosphorothioate linkage
cuuucuuuggucugcauucacau

SEQ ID NO: 889 - RNA, 23 nt, Artificial Sequence
  Description of Artificial Sequence: Synthetic oligonucleotide
  modified_base (1)..(1): 2'Fluoro-cytosine
  misc_feature (1)..(2): Phosphorothioate linkage
  modified_base (2)..(4): 2'Fluoro-uracil
  modified_base (5)..(5): 2'Fluoro-cytosine
  modified_base (6)..(8): 2'Fluoro-uracil
  modified_base (11)..(11): 2'Fluoro-uracil
  modified_base (12)..(12): 2'Fluoro-cytosine
  modified_base (13)..(13): 2'Fluoro-uracil
  modified_base (15)..(15): 2'Fluoro-cytosine
  modified_base (17)..(18): 2'Fluoro-uracil
  modified_base (19)..(19): 2'Fluoro-cytosine
  modified_base (21)..(21): 2'Fluoro-cytosine
  misc_feature (22)..(23): Phosphorothioate linkage
  modified_base (23)..(23): 2'Fluoro-uracil
cuuucuuuggucugcauucacau

SEQ ID NO: 890 - RNA, 23 nt, Artificial Sequence
  Description of Artificial Sequence: Synthetic oligonucleotide
  misc_feature (1)..(2): Phosphorothioate linkage
  modified_base (8)..(8): 2'Fluoro-uracil
  modified_base (13)..(13): 2'Fluoro-uracil
  modified_base (15)..(15): 2'Fluoro-cytosine
  modified_base (19)..(19): 2'Fluoro-cytosine
  misc_feature (22)..(23): Phosphorothioate linkage
cuuucuuuggucugcauucacau

SEQ ID NO: 891 - RNA, 19 nt, Artificial Sequence
  Description of Artificial Sequence: Synthetic oligonucleotide
  modified_base (1)..(1): 2'O-Methyl-cytosine
  misc_feature (1)..(2): Phosphorothioate linkage
  modified_base (2)..(2): 2'Fluoro-cytosine
  modified_base (3)..(3): 2'O-Methyl-cytosine
  modified_base (4)..(4): 2'Fluoro-uracil
  modified_base (5)..(5): 2'O-Methyl-guanine
  modified_base (6)..(6): 2'Fluoro-guanine
  modified_base (7)..(7): 2'O-Methyl-uracil
  modified_base (8)..(8): 2'Fluoro-guanine
  modified_base (9)..(9): 2'O-Methyl-guanine
  modified_base (10)..(10): 2'Fluoro-adenine
  modified_base (11)..(11): 2'O-Methyl-cytosine
  modified_base (12)..(12): 2'Fluoro-adenine
  modified_base (13)..(13): 2'O-Methyl-uracil
  modified_base (14)..(14): 2'Fluoro-cytosine
  modified_base (15)..(15): 2'O-Methyl-uracil
  modified_base (16)..(16): 2'Fluoro-uracil
  modified_base (17)..(17): 2'O-Methyl-cytosine
  modified_base (18)..(18): 2'Fluoro-cytosine
  misc_feature (18)..(19): Phosphorothioate linkage
  modified_base (19)..(19): 2'O-Methyl-adenine
cccugguggacaucuucca

SEQ ID NO: 892 - RNA, 19 nt, Artificial Sequence
  Description of Artificial Sequence: Synthetic oligonucleotide
  modified_base (1)..(1): 2'Fluoro-uracil
  misc_feature (1)..(2): Phosphorothioate linkage
  modified_base (2)..(2): 2'O-Methyl-guanine
  modified_base (3)..(3): 2'Fluoro-guanine
  modified_base (4)..(4): 2'O-Methyl-adenine
  modified_base (5)..(5): 2'Fluoro-adenine
  modified_base (6)..(6): 2'O-Methyl-guanine
  modified_base (7)..(7): 2'Fluoro-adenine
  modified_base (8)..(8): 2'O-Methyl-uracil
  modified_base (9)..(9): 2'Fluoro-guanine
  modified_base (10)..(10): 2'O-Methyl-uracil
  modified_base (11)..(11): 2'Fluoro-cytosine
  modified_base (12)..(12): 2'O-Methyl-cytosine
  modified_base (13)..(13): 2'Fluoro-adenine
  modified_base (14)..(14): 2'O-Methyl-cytosine
  modified_base (15)..(15): 2'Fluoro-cytosine
  modified_base (16)..(16): 2'O-Methyl-adenine
  modified_base (17)..(17): 2'Fluoro-guanine
  modified_base (18)..(18): 2'O-Methyl-guanine
  misc_feature (18)..(19): Phosphorothioate linkage
  modified_base (19)..(19): 2'Fluoro-guanine
uggaagauguccaccaggg

SEQ ID NO: 893 - RNA, 19 nt, Artificial Sequence
  Description of Artificial Sequence: Synthetic oligonucleotide
  modified_base (1)..(1): 2'O-Methyl-guanine
  misc_feature (1)..(2): Phosphorothioate linkage
  modified_base (2)..(2): 2'Fluoro-guanine
  modified_base (3)..(3): 2'O-Methyl-adenine
  modified_base (4)..(4): 2'Fluoro-cytosine
  modified_base (5)..(5): 2'O-Methyl-adenine
  modified_base (6)..(6): 2'Fluoro-uracil
  modified_base (7)..(7): 2'O-Methyl-cytosine
  modified_base (8)..(8): 2'Fluoro-uracil
  modified_base (9)..(9): 2'O-Methyl-uracil
  modified_base (10)..(10): 2'Fluoro-cytosine
  modified_base (11)..(11): 2'O-Methyl-cytosine
  modified_base (12)..(12): 2'Fluoro-adenine
  modified_base (13)..(13): 2'O-Methyl-guanine
  modified_base (14)..(14): 2'Fluoro-guanine
  modified_base (15)..(15): 2'O-Methyl-adenine
  modified_base (16)..(16): 2'Fluoro-guanine
  modified_base (17)..(17): 2'O-Methyl-uracil
  modified_base (18)..(18): 2'Fluoro-adenine
  misc_feature (18)..(19): Phosphorothioate linkage
  modified_base (19)..(19): 2'O-Methyl-cytosine
ggacaucuuccaggaguac

SEQ ID NO: 894 - RNA, 19 nt, Artificial Sequence
  Description of Artificial Sequence: Synthetic oligonucleotide
  modified_base (1)..(1): 2'Fluoro-guanine
  misc_feature (1)..(2): Phosphorothioate linkage
  modified_base (2)..(2): 2'O-Methyl-uracil
  modified_base (3)..(3): 2'Fluoro-adenine
  modified_base (4)..(4): 2'O-Methyl-cytosine
  modified_base (5)..(5): 2'Fluoro-uracil
  modified_base (6)..(6): 2'O-Methyl-cytosine
  modified_base (7)..(7): 2'Fluoro-cytosine
  modified_base (8)..(8): 2'O-Methyl-uracil
  modified_base (9)..(9): 2'Fluoro-guanine
  modified_base (10)..(10): 2'O-Methyl-guanine
  modified_base (11)..(11): 2'Fluoro-adenine
  modified_base (12)..(12): 2'O-Methyl-adenine
  modified_base (13)..(13): 2'Fluoro-guanine
  modified_base (14)..(14): 2'O-Methyl-adenine
  modified_base (15)..(15): 2'Fluoro-uracil
  modified_base (16)..(16): 2'O-Methyl-guanine
  modified_base (17)..(17): 2'Fluoro-uracil
  modified_base (18)..(18): 2'O-Methyl-cytosine
  misc_feature (18)..(19): Phosphorothioate linkage
  modified_base (19)..(19): 2'Fluoro-cytosine
guacuccuggaagaugucc

SEQ ID NO: 895 - RNA, 19 nt, Artificial Sequence
  Description of Artificial Sequence: Synthetic oligonucleotide
  modified_base (1)..(1): 2'O-Methyl-uracil
  misc_feature (1)..(2): Phosphorothioate linkage
  modified_base (2)..(2): 2'Fluoro-adenine
  modified_base (3)..(3): 2'O-Methyl-cytosine
  modified_base (4)..(4): 2'Fluoro-cytosine
  modified_base (5)..(5): 2'O-Methyl-cytosine
  modified_base (6)..(6): 2'Fluoro-uracil
  modified_base (7)..(7): 2'O-Methyl-guanine
  modified_base (8)..(8): 2'Fluoro-adenine
  modified_base (9)..(9): 2'O-Methyl-uracil
  modified_base (10)..(10): 2'Fluoro-guanine
  modified_base (11)..(11): 2'O-Methyl-adenine
  modified_base (12)..(12): 2'Fluoro-guanine
  modified_base (13)..(13): 2'O-Methyl-adenine
  modified_base (14)..(14): 2'Fluoro-uracil
  modified_base (15)..(15): 2'O-Methyl-cytosine
  modified_base (16)..(16): 2'Fluoro-guanine
  modified_base (17)..(17): 2'O-Methyl-adenine
  modified_base (18)..(18): 2'Fluoro-guanine
  misc_feature (18)..(19): Phosphorothioate linkage
  modified_base (19)..(19): 2'O-Methyl-uracil
uacccugaugagaucgagu

SEQ ID NO: 896 - RNA, 19 nt, Artificial Sequence
  Description of Artificial Sequence: Synthetic oligonucleotide
  modified_base (1)..(1): 2'Fluoro-adenine
  misc_feature (1)..(2): Phosphorothioate linkage
  modified_base (2)..(2): 2'O-Methyl-cytosine
  modified_base (3)..(3): 2'Fluoro-uracil
  modified_base (4)..(4): 2'O-Methyl-cytosine
  modified_base (5)..(5): 2'Fluoro-guanine
  modified_base (6)..(6): 2'O-Methyl-adenine
  modified_base (7)..(7): 2'Fluoro-uracil
  modified_base (8)..(8): 2'O-Methyl-cytosine
  modified_base (9)..(9): 2'Fluoro-uracil
  modified_base (10)..(10): 2'O-Methyl-cytosine
  modified_base (11)..(11): 2'Fluoro-adenine
  modified_base (12)..(12): 2'O-Methyl-uracil
  modified_base (13)..(13): 2'Fluoro-cytosine
  modified_base (14)..(14): 2'O-Methyl-adenine
  modified_base (15)..(15): 2'Fluoro-guanine
  modified_base (16)..(16): 2'O-Methyl-guanine
  modified_base (17)..(17): 2'Fluoro-guanine
  modified_base (18)..(18): 2'O-Methyl-uracil
  misc_feature (18)..(19): Phosphorothioate linkage
  modified_base (19)..(19): 2'Fluoro-adenine
acucgaucucaucagggua

SEQ ID NO: 897 - RNA, 19 nt, Artificial Sequence
  Description of Artificial Sequence: Synthetic oligonucleotide
  modified_base (1)..(1): 2'O-Methyl-adenine
  misc_feature (1)..(2): Phosphorothioate linkage
  modified_base (2)..(2): 2'Fluoro-cytosine
  modified_base (3)..(3): 2'O-Methyl-cytosine
  modified_base (4)..(4): 2'Fluoro-adenine
  modified_base (5)..(5): 2'O-Methyl-uracil
  modified_base (6)..(6): 2'Fluoro-guanine
  modified_base (7)..(7): 2'O-Methyl-cytosine
  modified_base (8)..(8): 2'Fluoro-adenine
  modified_base (9)..(9): 2'O-Methyl-guanine
  modified_base (10)..(10): 2'Fluoro-adenine
  modified_base (11)..(11): 2'O-Methyl-uracil
  modified_base (12)..(12): 2'Fluoro-uracil
  modified_base (13)..(13): 2'O-Methyl-adenine
  modified_base (14)..(14): 2'Fluoro-uracil
  modified_base (15)..(15): 2'O-Methyl-guanine
  modified_base (16)..(16): 2'Fluoro-cytosine
  modified_base (17)..(17): 2'O-Methyl-guanine
  modified_base (18)..(18): 2'Fluoro-guanine
  misc_feature (18)..(19): Phosphorothioate linkage
  modified_base (19)..(19): 2'O-Methyl-adenine
accaugcagauuaugcgga

SEQ ID NO: 898 - RNA, 19 nt, Artificial Sequence
  Description of Artificial Sequence: Synthetic oligonucleotide
  modified_base (1)..(1): 2'Fluoro-uracil
  misc_feature (1)..(2): Phosphorothioate linkage
  modified_base (2)..(2): 2'O-Methyl-cytosine
  modified_base (3)..(3): 2'Fluoro-cytosine
  modified_base (4)..(4): 2'O-Methyl-guanine
  modified_base (5)..(5): 2'Fluoro-cytosine
  modified_base (6)..(6): 2'O-Methyl-adenine
  modified_base (7)..(7): 2'Fluoro-uracil
  modified_base (8)..(8): 2'O-Methyl-adenine
  modified_base (9)..(9): 2'Fluoro-adenine
  modified_base (10)..(10): 2'O-Methyl-uracil
  modified_base (11)..(11): 2'Fluoro-cytosine
  modified_base (12)..(12): 2'O-Methyl-uracil
  modified_base (13)..(13): 2'Fluoro-guanine
  modified_base (14)..(14): 2'O-Methyl-cytosine
  modified_base (15)..(15): 2'Fluoro-adenine
  modified_base (16)..(16): 2'O-Methyl-uracil
  modified_base (17)..(17): 2'Fluoro-guanine
  modified_base (18)..(18): 2'O-Methyl-guanine
  misc_feature (18)..(19): Phosphorothioate linkage
  modified_base (19)..(19): 2'Fluoro-uracil
uccgcauaaucugcauggu

SEQ ID NO: 899 - RNA, 19 nt, Artificial Sequence
  Description of Artificial Sequence: Synthetic oligonucleotide
  modified_base (1)..(1): 2'O-Methyl-guanine
  misc_feature (1)..(2): Phosphorothioate linkage
  modified_base (2)..(2): 2'Fluoro-cytosine
  modified_base (3)..(3): 2'O-Methyl-guanine
  modified_base (4)..(4): 2'Fluoro-guanine
  modified_base (5)..(5): 2'O-Methyl-adenine
  modified_base (6)..(6): 2'Fluoro-uracil
  modified_base (7)..(7): 2'O-Methyl-cytosine
  modified_base (8)..(8): 2'Fluoro-adenine
  modified_base (9)..(9): 2'O-Methyl-adenine
  modified_base (10)..(10): 2'Fluoro-adenine
  modified_base (11)..(11): 2'O-Methyl-cytosine
  modified_base (12)..(12): 2'Fluoro-cytosine
  modified_base (13)..(13): 2'O-Methyl-uracil
  modified_base (14)..(14): 2'Fluoro-cytosine
  modified_base (15)..(15): 2'O-Methyl-adenine
  modified_base (16)..(16): 2'Fluoro-cytosine
  modified_base (17)..(17): 2'O-Methyl-cytosine
  modified_base (18)..(18): 2'Fluoro-adenine
  misc_feature (18)..(19): Phosphorothioate linkage
  modified_base (19)..(19): 2'O-Methyl-adenine
gcggaucaaaccucaccaa

SEQ ID NO: 900 - RNA, 19 nt, Artificial Sequence
  Description of Artificial Sequence: Synthetic oligonucleotide
  modified_base (1)..(1): 2'Fluoro-uracil
  misc_feature (1)..(2): Phosphorothioate linkage
  modified_base (3)..(3): 2'Fluoro-guanine
  modified_base (4)..(4): 2'O-Methyl-guanine
  modified_base (5)..(5): 2'Fluoro-uracil
  modified_base (6)..(6): 2'O-Methyl-guanine
  modified_base (7)..(7): 2'Fluoro-adenine
  modified_base (8)..(8): 2'O-Methyl-guanine
  modified_base (9)..(9): 2'Fluoro-guanine
  modified_base (10)..(10): 2'O-Methyl-uracil
  modified_base (11)..(11): 2'Fluoro-uracil
  modified_base (12)..(12): 2'O-Methyl-uracil
  modified_base (13)..(13): 2'Fluoro-guanine
  modified_base (14)..(14): 2'O-Methyl-adenine
  modified_base (15)..(15): 2'Fluoro-uracil
  modified_base (16)..(16): 2'O-Methyl-cytosine
  modified_base (17)..(17): 2'Fluoro-cytosine
  modified_base (18)..(18): 2'O-Methyl-guanine
  misc_feature (18)..(19): Phosphorothioate linkage
  modified_base (19)..(19): 2'Fluoro-cytosine
uuggugagguuugauccgc

SEQ ID NO: 901 - RNA, 19 nt, Artificial Sequence
  Description of Artificial Sequence: Synthetic oligonucleotide
  modified_base (1)..(1): 2'O-Methyl-guanine
  misc_feature (1)..(2): Phosphorothioate linkage
  modified_base (2)..(2): 2'Fluoro-cytosine
  modified_base (3)..(3): 2'O-Methyl-adenine
  modified_base (4)..(4): 2'Fluoro-cytosine
  modified_base (5)..(5): 2'O-Methyl-adenine
  modified_base (6)..(6): 2'Fluoro-uracil
  modified_base (7)..(7): 2'O-Methyl-adenine
  modified_base (8)..(8): 2'Fluoro-guanine
  modified_base (9)..(9): 2'O-Methyl-guanine
  modified_base (10)..(10): 2'Fluoro-adenine
  modified_base (11)..(11): 2'O-Methyl-guanine
  modified_base (12)..(12): 2'Fluoro-adenine
  modified_base (13)..(13): 2'O-Methyl-guanine
  modified_base (14)..(14): 2'Fluoro-adenine
  modified_base (15)..(15): 2'O-Methyl-uracil
  modified_base (16)..(16): 2'Fluoro-guanine
  modified_base (17)..(17): 2'O-Methyl-adenine
  modified_base (18)..(18): 2'Fluoro-guanine
  misc_feature (18)..(19): Phosphorothioate linkage
  modified_base (19)..(19): 2'O-Methyl-cytosine
gcacauaggagagaugagc

SEQ ID NO: 902 - RNA, 19 nt, Artificial Sequence
  Description of Artificial Sequence: Synthetic oligonucleotide
  modified_base (1)..(1): 2'Fluoro-guanine
  misc_feature (1)..(2): Phosphorothioate linkage
  modified_base (2)..(2): 2'O-Methyl-cytosine
  modified_base (3)..(3): 2'Fluoro-uracil
  modified_base (4)..(4): 2'O-Methyl-cytosine
  modified_base (5)..(5): 2'Fluoro-adenine
  modified_base (6)..(6): 2'O-Methyl-uracil
  modified_base (7)..(7): 2'Fluoro-cytosine
  modified_base (8)..(8): 2'O-Methyl-uracil
  modified_base (9)..(9): 2'Fluoro-cytosine
  modified_base (10)..(10): 2'O-Methyl-uracil
  modified_base (11)..(11): 2'Fluoro-cytosine
  modified_base (12)..(12): 2'O-Methyl-cytosine
  modified_base (13)..(13): 2'Fluoro-uracil
  modified_base (14)..(14): 2'O-Methyl-adenine
  modified_base (15)..(15): 2'Fluoro-uracil
  modified_base (16)..(16): 2'O-Methyl-guanine
  modified_base (17)..(17): 2'Fluoro-uracil
  modified_base (18)..(18): 2'O-Methyl-guanine
  misc_feature (18)..(19): Phosphorothioate linkage
  modified_base (19)..(19): 2'Fluoro-cytosine
gcucaucucuccuaugugc

SEQ ID NO: 903 - RNA, 19 nt, Artificial Sequence
  Description of Artificial Sequence: Synthetic oligonucleotide
  modified_base (1)..(1): 2'O-Methyl-cytosine
  misc_feature (1)..(2): Phosphorothioate linkage
  modified_base (2)..(2): 2'Fluoro-adenine
  modified_base (3)..(3): 2'O-Methyl-uracil
  modified_base (4)..(4): 2'Fluoro-adenine
  modified_base (5)..(5): 2'O-Methyl-guanine
  modified_base (6)..(6): 2'Fluoro-guanine
  modified_base (7)..(7): 2'O-Methyl-adenine
  modified_base (8)..(8): 2'Fluoro-guanine
  modified_base (9)..(9): 2'O-Methyl-adenine
  modified_base (10)..(10): 2'Fluoro-guanine
  modified_base (11)..(11): 2'O-Methyl-adenine
  modified_base (12)..(12): 2'Fluoro-uracil
  modified_base (13)..(13): 2'O-Methyl-guanine
  modified_base (14)..(14): 2'Fluoro-adenine
  modified_base (15)..(15): 2'O-Methyl-guanine
  modified_base (16)..(16): 2'Fluoro-cytosine
  modified_base (17)..(17): 2'O-Methyl-uracil
  modified_base (18)..(18): 2'Fluoro-uracil
  misc_feature (18)..(19): Phosphorothioate linkage
  modified_base (19)..(19): 2'O-Methyl-cytosine
cauaggagagaugagcuuc

SEQ ID NO: 904 - RNA, 19 nt, Artificial Sequence
  Description of Artificial Sequence: Synthetic oligonucleotide
  modified_base (1)..(1): 2'Fluoro-guanine
  misc_feature (1)..(2): Phosphorothioate linkage
  modified_base (2)..(2): 2'O-Methyl-adenine
  modified_base (3)..(3): 2'Fluoro-adenine
  modified_base (4)..(4): 2'O-Methyl-guanine
  modified_base (5)..(5): 2'Fluoro-cytosine
  modified_base (6)..(6): 2'O-Methyl-uracil
  modified_base (7)..(7): 2'Fluoro-cytosine
  modified_base (8)..(8): 2'O-Methyl-adenine
  modified_base (9)..(9): 2'Fluoro-uracil
  modified_base (10)..(10): 2'O-Methyl-cytosine
  modified_base (11)..(11): 2'Fluoro-uracil
  modified_base (12)..(12): 2'O-Methyl-cytosine
  modified_base (13)..(13): 2'Fluoro-uracil
  modified_base (14)..(14): 2'O-Methyl-cytosine
  modified_base (15)..(15): 2'Fluoro-cytosine
  modified_base (16)..(16): 2'O-Methyl-uracil
  modified_base (17)..(17): 2'Fluoro-adenine
  modified_base (18)..(18): 2'O-Methyl-uracil
  misc_feature (18)..(19): Phosphorothioate linkage
  modified_base (19)..(19): 2'Fluoro-guanine
gaagcucaucucuccuaug

SEQ ID NO: 905 - RNA, 19 nt, Artificial Sequence
  Description of Artificial Sequence: Synthetic oligonucleotide
  modified_base (1)..(1): 2'O-Methyl-uracil
  misc_feature (1)..(2): Phosphorothioate linkage
  modified_base (2)..(2): 2'Fluoro-guanine
  modified_base (3)..(3): 2'O-Methyl-uracil
  modified_base (4)..(4): 2'Fluoro-guanine
  modified_base (5)..(5): 2'O-Methyl-adenine
  modified_base (6)..(6): 2'Fluoro-adenine
  modified_base (7)..(7): 2'O-Methyl-uracil
  modified_base (8)..(8): 2'Fluoro-guanine
  modified_base (9)..(9): 2'O-Methyl-cytosine
  modified_base (10)..(10): 2'Fluoro-adenine
  modified_base (11)..(11): 2'O-Methyl-guanine
  modified_base (12)..(12): 2'Fluoro-adenine
  modified_base (13)..(13): 2'O-Methyl-cytosine
  modified_base (14)..(14): 2'Fluoro-cytosine
  modified_base (15)..(15): 2'O-Methyl-adenine
  modified_base (16)..(16): 2'Fluoro-adenine
  modified_base (17)..(17): 2'O-Methyl-adenine
  modified_base (18)..(18): 2'Fluoro-guanine
  misc_feature (18)..(19): Phosphorothioate linkage
  modified_base (19)..(19): 2'O-Methyl-adenine
ugugaaugcagaccaaaga

SEQ ID NO: 906 - RNA, 19 nt, Artificial Sequence
  Description of Artificial Sequence: Synthetic oligonucleotide
  modified_base (1)..(1): 2'Fluoro-uracil
  misc_feature (1)..(2): Phosphorothioate linkage
  modified_base (2)..(2): 2'O-Methyl-cytosine
  modified_base (3)..(3): 2'Fluoro-uracil
  modified_base (4)..(4): 2'O-Methyl-uracil
  modified_base (5)..(5): 2'Fluoro-uracil
  modified_base (6)..(6): 2'O-Methyl-guanine
  modified_base (7)..(7): 2'Fluoro-guanine
  modified_base (8)..(8): 2'O-Methyl-uracil
  modified_base (9)..(9): 2'Fluoro-cytosine
  modified_base (10)..(10): 2'O-Methyl-uracil
  modified_base (11)..(11): 2'Fluoro-guanine
  modified_base (12)..(12): 2'O-Methyl-cytosine
  modified_base (13)..(13): 2'Fluoro-adenine
  modified_base (14)..(14): 2'O-Methyl-uracil
  modified_base (15)..(15): 2'Fluoro-uracil
  modified_base (16)..(16): 2'O-Methyl-cytosine
  modified_base (17)..(17): 2'Fluoro-adenine
  modified_base (18)..(18): 2'O-Methyl-cytosine
  misc_feature (18)..(19): Phosphorothioate linkage
  modified_base (19)..(19): 2'Fluoro-adenine
ucuuuggucugcauucaca

SEQ ID NO: 907 - RNA, 19 nt, Artificial Sequence
  Description of Artificial Sequence: Synthetic oligonucleotide
  modified_base (1)..(1): 2'O-Methyl-guanine
  misc_feature (1)..(2): Phosphorothioate linkage
  modified_base (2)..(2): 2'Fluoro-uracil
  modified_base (3)..(3): 2'O-Methyl-guanine
  modified_base (4)..(4): 2'Fluoro-adenine
  modified_base (5)..(5): 2'O-Methyl-adenine
  modified_base (6)..(6): 2'Fluoro-uracil
  modified_base (7)..(7): 2'O-Methyl-guanine
  modified_base (8)..(8): 2'Fluoro-cytosine
  modified_base (9)..(9): 2'O-Methyl-adenine
  modified_base (10)..(10): 2'Fluoro-guanine
  modified_base (11)..(11): 2'O-Methyl-adenine
  modified_base (12)..(12): 2'Fluoro-cytosine
  modified_base (13)..(13): 2'O-Methyl-cytosine
  modified_base (14)..(14): 2'Fluoro-adenine
  modified_base (15)..(15): 2'O-Methyl-adenine
  modified_base (16)..(16): 2'Fluoro-adenine
  modified_base (17)..(17): 2'O-Methyl-guanine
  modified_base (18)..(18): 2'Fluoro-adenine
  misc_feature (18)..(19): Phosphorothioate linkage
  modified_base (19)..(19): 2'O-Methyl-adenine
gugaaugcagaccaaagaa

SEQ ID NO: 908 - RNA, 19 nt, Artificial Sequence
  Description of Artificial Sequence: Synthetic oligonucleotide
  modified_base (1)..(1): 2'Fluoro-uracil
  misc_feature (1)..(2): Phosphorothioate linkage
  modified_base (2)..(2): 2'O-Methyl-uracil
  modified_base (3)..(3): 2'Fluoro-cytosine
  modified_base (4)..(4): 2'O-Methyl-uracil
  modified_base (5)..(5): 2'Fluoro-uracil
  modified_base (6)..(6): 2'O-Methyl-uracil
  modified_base (7)..(7): 2'Fluoro-guanine
  modified_base (8)..(8): 2'O-Methyl-guanine
  modified_base (9)..(9): 2'Fluoro-uracil
  modified_base (10)..(10): 2'O-Methyl-cytosine
  modified_base (11)..(11): 2'Fluoro-uracil
  modified_base (12)..(12): 2'O-Methyl-guanine
  modified_base (13)..(13): 2'Fluoro-cytosine
  modified_base (14)..(14): 2'O-Methyl-adenine
  modified_base (15)..(15): 2'Fluoro-uracil
  modified_base (16)..(16): 2'O-Methyl-uracil
  modified_base (17)..(17): 2'Fluoro-cytosine
  modified_base (18)..(18): 2'O-Methyl-adenine
  misc_feature (18)..(19): Phosphorothioate linkage
  modified_base (19)..(19): 2'Fluoro-cytosine
uucuuuggucugcauucac

SEQ ID NO: 909 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  misc_feature (2)..(3): Phosphorothioate linkage
  modified_base (14)..(14): 2'O-Methyl-cytosine
  modified_base (17)..(17): 2'O-Methyl-cytosine
  misc_feature (18)..(19): Phosphorothioate linkage
  misc_feature (19)..(20): Phosphorothioate linkage
  misc_feature (20)..(21): Phosphorothioate linkage
  3' Conjugation to hydroxyprolinol cholesterol through a phosphorothioate linkage
gcggaucaaaccucaccaatt

SEQ ID NO: 910 - DNA, 21 bp, Artificial Sequence
  Description of Combined DNA/RNA molecule: Synthetic oligonucleotide
  Description of Artificial Sequence: Synthetic oligonucleotide
  5' Conjugation to hydroxyprolinol cholesterol through a phosphorothioate linkage
  misc_feature (1)..(2): Phosphorothioate linkage
  modified_base (7)..(7): 2'O-Methyl-cytosine
  modified_base (14)..(14): 2'O-Methyl-cytosine
  modified_base (17)..(17): 2'O-Methyl-cytosine
  misc_feature (20)..(21): Phosphorothioate linkage
gcggaucaaaccucaccaatt

SEQ ID NO: 911 - DNA, 21 bp, Artificial Sequence
  Description of Combined DNA/RNA molecule: Synthetic oligonucleotide
  Description of Artificial Sequence: Synthetic oligonucleotide
  5' Conjugation to hydroxyprolinol cholesterol through a phosphorothioate linkage
  misc_feature (1)..(2): Phosphorothioate linkage
  modified_base (7)..(7): 2'O-Methyl-cytosine
  modified_base (14)..(14): 2'O-Methyl-cytosine
  modified_base (16)..(17): 2'O-Methyl-cytosine
  misc_feature (20)..(21): Phosphorothioate linkage
gcggaucaaaccucaccaatt

SEQ ID NO: 912 - DNA, 20 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (7)..(7): 2'O-Methyl-cytosine
  modified_base (14)..(14): 2'O-Methyl-cytosine
  modified_base (17)..(17): 2'O-Methyl-cytosine
  3' Conjugation to hydroxyprolinol cholesterol through a phosphorothioate linkage
gcggaucaaaccucaccaat

SEQ ID NO: 913 - DNA, 21 bp, Artificial Sequence
  Description of Combined DNA/RNA molecule: Synthetic oligonucleotide
  Description of Artificial Sequence: Synthetic oligonucleotide
  5' Conjugation to hydroxyprolinol cholesterol
  modified_base (1)..(3): 2'O-Methyl-cytosine
  modified_base (4)..(4): 2'O-Methyl-uracil
  modified_base (7)..(7): 2'O-Methyl-uracil
  modified_base (11)..(11): 2'O-Methyl-cytosine
  modified_base (13)..(13): 2'O-Methyl-uracil
  modified_base (14)..(14): 2'O-Methyl-cytosine
  modified_base (15)..(16): 2'O-Methyl-uracil
  modified_base (17)..(18): 2'O-Methyl-cytosine
  misc_feature (20)..(21): Phosphorothioate linkage
cccugguggacaucuuccatt

SEQ ID NO: 914 - DNA, 21 bp, Artificial Sequence
  Description of Combined DNA/RNA molecule: Synthetic oligonucleotide
  Description of Artificial Sequence: Synthetic oligonucleotide
  5' Conjugation to hydroxyprolinol cholesterol through a phosphorothioate linkage
  modified_base (1)..(3): 2'O-Methyl-cytosine
  modified_base (4)..(4): 2'O-Methyl-uracil
  modified_base (7)..(7): 2'O-Methyl-uracil
  modified_base (11)..(11): 2'O-Methyl-cytosine
  modified_base (13)..(13): 2'O-Methyl-uracil
  modified_base (14)..(14): 2'O-Methyl-cytosine
  modified_base (15)..(16): 2'O-Methyl-uracil
  modified_base (17)..(18): 2'O-Methyl-cytosine
  misc_feature (20)..(21): Phosphorothioate linkage
cccugguggacaucuuccatt

SEQ ID NO: 915 - DNA, 21 bp, Artificial Sequence
  Description of Combined DNA/RNA molecule: Synthetic oligonucleotide
  Description of Artificial Sequence: Synthetic oligonucleotide
  5' Conjugation to hydroxyprolinol cholesterol
  modified_base (1)..(1): 2'O-Methyl-adenine
  modified_base (3)..(3): 2'O-Methyl-cytosine
  modified_base (5)..(5): 2'O-Methyl-uracil
  modified_base (7)..(7): 2'O-Methyl-cytosine
  modified_base (11)..(12): 2'O-Methyl-uracil
  modified_base (14)..(14): 2'O-Methyl-uracil
  modified_base (16)..(16): 2'O-Methyl-cytosine
  misc_feature (20)..(21): Phosphorothioate linkage
accaugcagauuaugcggatt

SEQ ID NO: 916 - DNA, 21 bp, Artificial Sequence
  Description of Combined DNA/RNA molecule: Synthetic oligonucleotide
  Description of Artificial Sequence: Synthetic oligonucleotide
  5' Conjugation to hydroxyprolinol cholesterol through a phosphorothioate linkage
  modified_base (1)..(1): 2'O-Methyl-adenine
  modified_base (3)..(3): 2'O-Methyl-cytosine
  modified_base (5)..(5): 2'O-Methyl-uracil
  modified_base (7)..(7): 2'O-Methyl-cytosine
  modified_base (11)..(12): 2'O-Methyl-uracil
  modified_base (14)..(14): 2'O-Methyl-uracil
  modified_base (16)..(16): 2'O-Methyl-cytosine
  misc_feature (20)..(21): Phosphorothioate linkage
accaugcagauuaugcggatt

SEQ ID NO: 917 - DNA, 21 bp, Artificial Sequence
  Description of Combined DNA/RNA molecule: Synthetic oligonucleotide
  Description of Artificial Sequence: Synthetic oligonucleotide
  5' Conjugation to hydroxyprolinol cholesterol
  modified_base (1)..(1): 2'O-Methyl-cytosine
  modified_base (3)..(3): 2'O-Methyl-uracil
  modified_base (12)..(12): 2'O-Methyl-uracil
  modified_base (16)..(16): 2'O-Methyl-cytosine
  modified_base (17)..(18): 2'O-Methyl-uracil
  modified_base (19)..(19): 2'O-Methyl-cytosine
  misc_feature (20)..(21): Phosphorothioate linkage
cauaggagagaugagcuuctt

SEQ ID NO: 918 - DNA, 21 bp, Artificial Sequence
  Description of Combined DNA/RNA molecule: Synthetic oligonucleotide
  Description of Artificial Sequence: Synthetic oligonucleotide
  5' Conjugation to hydroxyprolinol cholesterol through a phosphorothioate linkage
  modified_base (1)..(1): 2'O-Methyl-cytosine
  modified_base (3)..(3): 2'O-Methyl-uracil
  modified_base (12)..(12): 2'O-Methyl-uracil
  modified_base (16)..(16): 2'O-Methyl-cytosine
  modified_base (17)..(18): 2'O-Methyl-uracil
  modified_base (19)..(19): 2'O-Methyl-cytosine
  misc_feature (20)..(21): Phosphorothioate linkage
cauaggagagaugagcuuctt

SEQ ID NO: 919 - RNA, 21 nt, Artificial Sequence
  Description of Artificial Sequence: Synthetic oligonucleotide
  5' Conjugation to hydroxyprolinol cholesterol
  modified_base (2)..(2): 2'O-Methyl-cytosine
  modified_base (4)..(4): 2'O-Methyl-cytosine
  modified_base (6)..(6): 2'O-Methyl-uracil
  modified_base (15)..(15): 2'O-Methyl-uracil
  modified_base (19)..(19): 2'O-Methyl-cytosine
  modified_base (20)..(21): 2'O-Methyl-uracil
  misc_feature (20)..(21): Phosphorothioate linkage
gcacauaggagagaugagcuu

SEQ ID NO: 920 - DNA, 20 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (7)..(7): 2'O-Methyl-cytosine
  modified_base (14)..(14): 2'O-Methyl-cytosine
  modified_base (17)..(17): 2'O-Methyl-cytosine
  3' Conjugation to cholanic acid through a phosphorothioate linkage
gcggaucaaaccucaccaat

SEQ ID NO: 921 - DNA, 20 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (7)..(7): 2'O-Methyl-cytosine
  modified_base (14)..(14): 2'O-Methyl-cytosine
  modified_base (16)..(17): 2'O-Methyl-cytosine
  3' Conjugation to cholanic acid through a phosphorothioate linkage
gcggaucaaaccucaccaat

SEQ ID NO: 922 - DNA, 20 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 5-Methyl-2'-Fluoro-uridine
  modified_base (5)..(5): 5-Methyl-2'-Fluoro-uridine
  modified_base (11)..(12): 5-Methyl-2'-Fluoro-uridine
  3' Conjugation to cholanic acid through a phosphorothioate linkage
uuggugagguuugauccgct

SEQ ID NO: 923 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  misc_feature (20)..(21): Phosphorothioate linkage
uuggugagguuugauccgctt

SEQ ID NO: 924 - DNA, 21 bp, Artificial Sequence
  Description of Combined DNA/RNA molecule: Synthetic oligonucleotide
  Description of Artificial Sequence: Synthetic oligonucleotide
uuggugagguuugauccgctt

SEQ ID NO: 925 - RNA, 23 nt, Artificial Sequence
  Description of Artificial Sequence: Synthetic oligonucleotide
  modified_base (3)..(3): 2'Fluoro-guanine
  modified_base (4)..(4): 2'Fluoro-cytosine
  modified_base (5)..(5): 2'Fluoro-uracil
  modified_base (7)..(7): 2'Fluoro-adenine
  modified_base (8)..(8): 2'Fluoro-uracil
  modified_base (9)..(9): 2'Fluoro-cytosine
  modified_base (10)..(10): 2'Fluoro-uracil
  modified_base (11)..(11): 2'Fluoro-cytosine
  modified_base (12)..(12): 2'Fluoro-uracil
  modified_base (13)..(14): 2'Fluoro-cytosine
  modified_base (16)..(16): 2'Fluoro-adenine
  modified_base (18)..(18): 2'Fluoro-guanine
  modified_base (20)..(20): 2'Fluoro-guanine
  modified_base (21)..(21): 2'Fluoro-cytosine
  misc_feature (22)..(23): Phosphorothioate linkage
aagcucaucucuccuaugugcug

SEQ ID NO: 926 - DNA, 20 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (7)..(7): 2'O-Methyl-cytosine
  modified_base (14)..(14): 2'O-Methyl-cytosine
  modified_base (17)..(17): 2'O-Methyl-cytosine
  3' Conjugation to cholanic acid through a phosphorothioate linkage
gcggaucaaaccucaccaat

SEQ ID NO: 927 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  misc_feature (20)..(21): Phosphorothioate linkage
uuggugagguuugauccgctt

SEQ ID NO: 928 - DNA, 20 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (7)..(7): 2'O-Methyl-cytosine
  modified_base (14)..(14): 2'O-Methyl-cytosine
  modified_base (16)..(17): 2'O-Methyl-cytosine
  3' Conjugation to cholanic acid through a phosphorothioate linkage
gcggaucaaaccucaccaat

SEQ ID NO: 929 - DNA, 21 bp, Artificial Sequence
  Description of Combined DNA/RNA molecule: Synthetic oligonucleotide
  Description of Artificial Sequence: Synthetic oligonucleotide
gcggaucaaaccucaccaatt

SEQ ID NO: 930 - RNA, 21 nt, Artificial Sequence
  Description of Artificial Sequence: Synthetic oligonucleotide
  5' Conjugation to hydroxyprolinol cholesterol
  modified_base (1)..(1): 2'O-Methyl-guanine
  modified_base (3)..(3): 2'O-Methyl-adenine
  modified_base (5)..(5): 2'O-Methyl-adenine
  modified_base (14)..(14): 2'O-Methyl-adenine
  modified_base (19)..(19): 2'O-Methyl-cytosine
  misc_feature (20)..(21): Phosphorothioate linkage
gcacauaggagagaugagcuu

SEQ ID NO: 931 - RNA, 21 nt, Artificial Sequence
  Description of Artificial Sequence: Synthetic oligonucleotide
  modified_base (1)..(1): 2'O-Methyl-guanine
  misc_feature (1)..(2): Phosphorothioate linkage
  modified_base (3)..(3): 2'O-Methyl-adenine
  modified_base (5)..(5): 2'O-Methyl-adenine
  modified_base (14)..(14): 2'O-Methyl-adenine
  modified_base (19)..(19): 2'O-Methyl-cytosine
  3' Conjugation to hydroxyprolinol cholesterol
gcacauaggagagaugagcuu

SEQ ID NO: 932 - RNA, 21 nt, Artificial Sequence
  Description of Artificial Sequence: Synthetic oligonucleotide
  5' Conjugation to thio-hydroxyprolinol cholesterol
  modified_base (1)..(1): 2'O-Methyl-guanine
  modified_base (3)..(3): 2'O-Methyl-adenine
  modified_base (5)..(5): 2'O-Methyl-adenine
  modified_base (14)..(14): 2'O-Methyl-adenine
  modified_base (19)..(19): 2'O-Methyl-cytosine
  misc_feature (20)..(21): Phosphorothioate linkage
gcacauaggagagaugagcuu

SEQ ID NO: 933 - RNA, 21 nt, Artificial Sequence
  Description of Artificial Sequence: Synthetic oligonucleotide
  5' Conjugation to hydroxyprolinol cholesterol
  modified_base (1)..(1): 2'O-Methyl-guanine
  modified_base (3)..(3): 2'O-Methyl-adenine
  modified_base (5)..(5): 2'O-Methyl-adenine
  modified_base (14)..(14): 2'O-Methyl-adenine
  modified_base (19)..(19): 2'O-Methyl-cytosine
  modified_base (21)..(21): uracil-NH2
gcacauaggagagaugagcuu

SEQ ID NO: 934 - RNA, 23 nt, Artificial Sequence
  Description of Artificial Sequence: Synthetic oligonucleotide
aagcucaucucuccuaugugcug

SEQ ID NO: 935 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 5-Methyl-2'-Fluoro-uridine
  modified_base (5)..(5): 5-Methyl-2'-Fluoro-uridine
  modified_base (11)..(12): 5-Methyl-2'-Fluoro-uridine
  misc_feature (20)..(21): Phosphorothioate linkage
  3' Conjugation to naproxen by a serinol linker via a phosphorothioate linkage
uuggugagguuugauccgctt

SEQ ID NO: 936 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 5-Methyl-2'-Fluoro-uridine
  modified_base (5)..(5): 5-Methyl-2'-Fluoro-uridine
  modified_base (11)..(12): 5-Methyl-2'-Fluoro-uridine
  misc_feature (20)..(21): Phosphorothioate linkage
  3' Conjugation to biotin through a phosphorothioate linkage
uuggugagguuugauccgctt

SEQ ID NO: 937 - RNA, 23 nt, Artificial Sequence
  Description of Artificial Sequence: Synthetic oligonucleotide
  misc_feature (1)..(2): Phosphorothioate linkage
  modified_base (6)..(6): 2'O-Methyl-cytosine
  modified_base (15)..(15): 2'O-Methyl-uracil
  modified_base (17)..(17): 2'O-Methyl-uracil
  modified_base (19)..(19): 2'O-Methyl-uracil
  modified_base (21)..(21): 2'O-Methyl-cytosine
  modified_base (22)..(22): 2'O-Methyl-uracil
  misc_feature (22)..(23): Phosphorothioate linkage
  3' Conjugation to biotin through a phosphorothioate linkage
aagcucaucucuccuaugugcug

SEQ ID NO: 938 - RNA, 21 nt, Artificial Sequence
  Description of Artificial Sequence: Synthetic oligonucleotide
  5' Conjugation to aminooxy-linker
gcacauaggagagaugagcuu

SEQ ID NO: 939 - RNA, 23 nt, Artificial Sequence
  Description of Artificial Sequence: Synthetic oligonucleotide
  misc_feature (22)..(23): Phosphorothioate linkage
aagcucaucucuccuaugugcug

SEQ ID NO: 940 - RNA, 21 nt, Artificial Sequence
  Description of Artificial Sequence: Synthetic oligonucleotide
  misc_feature (20)..(21): Phosphorothioate linkage
gaacugugugugagagguccu

SEQ ID NO: 941 - RNA, 21 nt, Artificial Sequence
  Description of Artificial Sequence: Synthetic oligonucleotide
  5' Conjugation to all-trans-retinal-aminooxy
gcacauaggagagaugagcuu

SEQ ID NO: 942 - RNA, 23 nt, Artificial Sequence
  Description of Artificial Sequence: Synthetic oligonucleotide
  misc_feature (22)..(23): Phosphorothioate linkage
aagcucaucucuccuaugugcug

SEQ ID NO: 943 - RNA, 21 nt, Artificial Sequence
  Description of Artificial Sequence: Synthetic oligonucleotide
  3' Conjugation to hydroxyprolinol amine through a phosphorothioate linkage
gcacauaggagagaugacguu

SEQ ID NO: 944 - RNA, 21 nt, Artificial Sequence
  Description of Artificial Sequence: Synthetic oligonucleotide
  misc_feature (1)..(2): Phosphorothioate linkage
  3' Conjugation to hydroxyprolinol amine
gucaucacacugaauaccaau

SEQ ID NO: 945 - DNA, 21 bp, Artificial Sequence
  Description of Combined DNA/RNA molecule: Synthetic oligonucleotide
  Description of Artificial Sequence: Synthetic oligonucleotide
  5' Conjugation to hydroxyprolinol amine
  misc_feature (20)..(21): Phosphorothioate linkage
cuuacgcugaguacuucgatt

SEQ ID NO: 946 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  3' Conjugation to hydroxyprolinol amine
cuuacgcugaguacuucgatt

SEQ ID NO: 947 - DNA, 21 bp, Artificial Sequence
  Description of Combined DNA/RNA molecule: Synthetic oligonucleotide
  Description of Artificial Sequence: Synthetic oligonucleotide
uuggugaggauugauccgctt

SEQ ID NO: 948 - DNA, 21 bp, Artificial Sequence
  Description of Combined DNA/RNA molecule: Synthetic oligonucleotide
  Description of Artificial Sequence: Synthetic oligonucleotide
uuggugaggguugauccgctt

SEQ ID NO: 949 - DNA, 21 bp, Artificial Sequence
  Description of Combined DNA/RNA molecule: Synthetic oligonucleotide
  Description of Artificial Sequence: Synthetic oligonucleotide
uuggugaggcuugauccgctt

SEQ ID NO: 950 - DNA, 21 bp, Artificial Sequence
  Description of Combined DNA/RNA molecule: Synthetic oligonucleotide
  Description of Artificial Sequence: Synthetic oligonucleotide
  modified_base (10)..(10): Ribo-difluorotoluene
uuggugaggnuugauccgctt

SEQ ID NO: 951 - DNA, 21 bp, Artificial Sequence
  Description of Combined DNA/RNA molecule: Synthetic oligonucleotide
  Description of Artificial Sequence: Synthetic oligonucleotide
  modified_base (11)..(11): Ribo-difluorotoluene
uuggugaggunugauccgctt

SEQ ID NO: 952 - DNA, 21 bp, Artificial Sequence
  Description of Combined DNA/RNA molecule: Synthetic oligonucleotide
  Description of Artificial Sequence: Synthetic oligonucleotide
  modified_base (10)..(10): Ribo-difluorotoluene
  modified_base (12)..(12): Ribo-difluorotoluene
uuggugaggnungauccgctt

SEQ ID NO: 953 - DNA, 21 bp, Artificial Sequence
  Description of Combined DNA/RNA molecule: Synthetic oligonucleotide
  Description of Artificial Sequence: Synthetic oligonucleotide
  modified_base (10)..(12): Ribo-difluorotoluene
uuggugaggnnngauccgctt

SEQ ID NO: 954 - DNA, 21 bp, Artificial Sequence
  Description of Combined DNA/RNA molecule: Synthetic oligonucleotide
  Description of Artificial Sequence: Synthetic oligonucleotide
gcggaucaagccucaccaatt

SEQ ID NO: 955 - DNA, 21 bp, Artificial Sequence
  Description of Combined DNA/RNA molecule: Synthetic oligonucleotide
  Description of Artificial Sequence: Synthetic oligonucleotide
gcggaucaacccucaccaatt

SEQ ID NO: 956 - DNA, 21 bp, Artificial Sequence
  Description of Combined DNA/RNA molecule: Synthetic oligonucleotide
  Description of Artificial Sequence: Synthetic oligonucleotide
gcggaucaauccucaccaatt

SEQ ID NO: 957 - DNA, 21 bp, Artificial Sequence
  Description of Combined DNA/RNA molecule: Synthetic oligonucleotide
  Description of Artificial Sequence: Synthetic oligonucleotide
  modified_base (2)..(2): 2'-arafluoro-thymidine
  modified_base (5)..(5): 2'-arafluoro-thymidine
  modified_base (12)..(12): 2'-arafluoro-thymidine
utggtgagguutgauccgctt

SEQ ID NO: 958 - DNA, 21 bp, Artificial Sequence
  Description of Combined DNA/RNA molecule: Synthetic oligonucleotide
  Description of Artificial Sequence: Synthetic oligonucleotide
  modified_base (2)..(2): 2'-arafluoro-thymidine
  modified_base (5)..(5): 2'-arafluoro-thymidine
  modified_base (11)..(12): 2'-arafluoro-thymidine
utggtgagguttgauccgctt

SEQ ID NO: 959 - DNA, 21 bp, Artificial Sequence
  Description of Combined DNA/RNA molecule: Synthetic oligonucleotide
  Description of Artificial Sequence: Synthetic oligonucleotide
  modified_base (2)..(2): 2'-arafluoro-2'-deoxy-uridine
  modified_base (5)..(5): 2'-arafluoro-2'-deoxy-uridine
  modified_base (12)..(12): 2'-arafluoro-2'-deoxy-uridine
uuggugagguuugauccgctt

SEQ ID NO: 960 - DNA, 21 bp, Artificial Sequence
  Description of Combined DNA/RNA molecule: Synthetic oligonucleotide
  Description of Artificial Sequence: Synthetic oligonucleotide
  modified_base (2)..(2): 2'-arafluoro-2'-deoxy-uridine
  modified_base (5)..(5): 2'-arafluoro-2'-deoxy-uridine
  modified_base (11)..(12): 2'-arafluoro-2'-deoxy-uridine
uuggugagguuugauccgctt

SEQ ID NO: 961 - DNA, 21 bp, Artificial Sequence
  Description of Combined DNA/RNA molecule: Synthetic oligonucleotide
  Description of Artificial Sequence: Synthetic oligonucleotide
  modified_base (7)..(7): 2'-arafluoro-2'-deoxy-cytidine
  modified_base (14)..(14): 2'-arafluoro-2'-deoxy-cytidine
  modified_base (16)..(17): 2'-arafluoro-2'-deoxy-cytidine
gcggaucaaaccucaccaatt

SEQ ID NO: 962 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  misc_feature (2)..(3): Phosphorothioate linkage
  misc_feature (7)..(8): Methyl phosphonate linkage
  misc_feature (14)..(15): Methyl phosphonate linkage
  misc_feature (17)..(18): Methyl phosphonate linkage
  misc_feature (18)..(19): Phosphorothioate linkage
  misc_feature (19)..(20): Phosphorothioate linkage
  misc_feature (20)..(21): Phosphorothioate linkage
gcggaucaaaccucaccaatt

SEQ ID NO: 963 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  misc_feature (2)..(3): Sulfated methyl phosphonate linkage
  misc_feature (11)..(12): Methyl phosphonate linkage
  misc_feature (18)..(19): Phosphorothioate linkage
  misc_feature (19)..(20): Phosphorothioate linkage
  misc_feature (20)..(21): Phosphorothioate linkage
uuggugagguuugauccgctt

SEQ ID NO: 964 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  misc_feature (2)..(3): Sulfated methyl phosphonate linkage
  misc_feature (5)..(6): Methyl phosphonate linkage
  misc_feature (11)..(12): Methyl phosphonate linkage
  misc_feature (12)..(13): Methyl phosphonate linkage
  misc_feature (18)..(19): Phosphorothioate linkage
  misc_feature (19)..(20): Phosphorothioate linkage
  misc_feature (20)..(21): Phosphorothioate linkage
uuggugagguuugauccgctt

SEQ ID NO: 965 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): Allyamino-uracil
  misc_feature (2)..(3): Phosphorothioate linkage
  modified_base (5)..(5): Allyamino-uracil
  modified_base (12)..(12): Allyamino-uracil
  misc_feature (18)..(19): Phosphorothioate linkage
  misc_feature (19)..(20): Phosphorothioate linkage
  misc_feature (20)..(21): Phosphorothioate linkage
uuggugagguuugauccgctt

SEQ ID NO: 966 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): Allyamino-uracil
  misc_feature (2)..(3): Phosphorothioate linkage
  modified_base (5)..(5): Allyamino-uracil
  modified_base (11)..(12): Allyamino-uracil
  misc_feature (18)..(19): Phosphorothioate linkage
  misc_feature (19)..(20): Phosphorothioate linkage
  misc_feature (20)..(21): Phosphorothioate linkage
uuggugagguuugauccgctt

SEQ ID NO: 967 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  misc_feature (19)..(20): Phosphorothioate linkage
  misc_feature (20)..(21): Phosphorothioate linkage
gcacauaggagagaugagctt

SEQ ID NO: 968 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  misc_feature (12)..(13): Phosphorothioate linkage
  misc_feature (19)..(20): Phosphorothioate linkage
  misc_feature (20)..(21): Phosphorothioate linkage
gcucaucucuccuaugugctt

SEQ ID NO: 969 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  misc_feature (2)..(3): Phosphorothioate linkage
  misc_feature (18)..(19): Phosphorothioate linkage
  misc_feature (19)..(20): Phosphorothioate linkage
  misc_feature (20)..(21): Phosphorothioate linkage
gcacauaggagagaugagctt

SEQ ID NO: 970 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  misc_feature (6)..(7): Phosphorothioate linkage
  misc_feature (19)..(20): Phosphorothioate linkage
  misc_feature (20)..(21): Phosphorothioate linkage
gcacauaggagagaugagctt

SEQ ID NO: 971 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  misc_feature (2)..(3): Phosphorothioate linkage
  misc_feature (18)..(19): Phosphorothioate linkage
  misc_feature (19)..(20): Phosphorothioate linkage
  misc_feature (20)..(21): Phosphorothioate linkage
gcggaacaauccugaccaatt

SEQ ID NO: 972 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  misc_feature (2)..(3): Phosphorothioate linkage
  misc_feature (18)..(19): Phosphorothioate linkage
  misc_feature (19)..(20): Phosphorothioate linkage
  misc_feature (20)..(21): Phosphorothioate linkage
uuggucaggauuguuccgctt

SEQ ID NO: 973 - DNA, 21 bp, Artificial Sequence
  Description of Combined DNA/RNA molecule: Synthetic oligonucleotide
  Description of Artificial Sequence: Synthetic oligonucleotide
gcggaacaauccugaccaatt

SEQ ID NO: 974 - DNA, 21 bp, Artificial Sequence
  Description of Combined DNA/RNA molecule: Synthetic oligonucleotide
  Description of Artificial Sequence: Synthetic oligonucleotide
uuggucaggauuguuccgctt

SEQ ID NO: 975 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  misc_feature (2)..(3): Phosphorothioate linkage
  misc_feature (18)..(19): Phosphorothioate linkage
  misc_feature (19)..(20): Phosphorothioate linkage
  misc_feature (20)..(21): Phosphorothioate linkage
gcggaucaaaccucaccaatt

SEQ ID NO: 976 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  misc_feature (2)..(3): Phosphorothioate linkage
  misc_feature (18)..(19): Phosphorothioate linkage
  misc_feature (19)..(20): Phosphorothioate linkage
  misc_feature (20)..(21): Phosphorothioate linkage
uuggugagguuugauccgctt

SEQ ID NO: 977 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  misc_feature (19)..(20): Phosphorothioate linkage
  misc_feature (20)..(21): Phosphorothioate linkage
gcggaucaaaccucaccaatt

SEQ ID NO: 978 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  misc_feature (19)..(20): Phosphorothioate linkage
  misc_feature (20)..(21): Phosphorothioate linkage
uuggugagguuugauccgctt

SEQ ID NO: 979 - RNA, 19 nt, Artificial Sequence
  Description of Artificial Sequence: Synthetic oligonucleotide
uucuuuggucugcauucac

SEQ ID NO: 980 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  misc_feature (18)..(19): Phosphorothioate linkage
  misc_feature (19)..(20): Phosphorothioate linkage
  misc_feature (20)..(21): Phosphorothioate linkage
uuggugagguuugauccgctt

SEQ ID NO: 981 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  misc_feature (2)..(3): Phosphorothioate linkage
  misc_feature (14)..(15): Phosphorothioate linkage
  misc_feature (17)..(18): Phosphorothioate linkage
  misc_feature (18)..(19): Phosphorothioate linkage
  misc_feature (19)..(20): Phosphorothioate linkage
  misc_feature (20)..(21): Phosphorothioate linkage
gcggaucaaaccucaccaatt

SEQ ID NO: 982 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  misc_feature (2)..(3): Phosphorothioate linkage
  misc_feature (13)..(14): Phosphorothioate linkage
  misc_feature (18)..(19): Phosphorothioate linkage
  misc_feature (19)..(20): Phosphorothioate linkage
  misc_feature (20)..(21): Phosphorothioate linkage
gcucaucucuccuaugugctt

SEQ ID NO: 983 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  misc_feature (2)..(3): Phosphorothioate linkage
  modified_base (14)..(14): 2'O-Methyl-cytosine
  modified_base (17)..(17): 2'O-Methyl-cytosine
  misc_feature (18)..(19): Phosphorothioate linkage
  misc_feature (19)..(20): Phosphorothioate linkage
  misc_feature (20)..(21): Phosphorothioate linkage
gcggaucaaaccucaccaatt

SEQ ID NO: 984 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  misc_feature (2)..(3): Phosphorothioate linkage
  modified_base (13)..(13): 2'O-Methyl-uracil
  modified_base (14)..(14): 2'O-Methyl-cytosine
  modified_base (16)..(17): 2'O-Methyl-cytosine
  misc_feature (18)..(19): Phosphorothioate linkage
  misc_feature (19)..(20): Phosphorothioate linkage
  misc_feature (20)..(21): Phosphorothioate linkage
gcggaucaaaccucaccaatt

SEQ ID NO: 985 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  misc_feature (2)..(3): Phosphorothioate linkage
  modified_base (14)..(14): 2'O-Methyl-cytosine
  misc_feature (14)..(15): Phosphorothioate linkage
  modified_base (17)..(17): 2'O-Methyl-cytosine
  misc_feature (17)..(18): Phosphorothioate linkage
  misc_feature (18)..(19): Phosphorothioate linkage
  misc_feature (19)..(20): Phosphorothioate linkage
  misc_feature (20)..(21): Phosphorothioate linkage
gcggaucaaaccucaccaatt

SEQ ID NO: 986 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  misc_feature (2)..(3): Phosphorothioate linkage
  modified_base (7)..(7): 2'O-Methyl-cytosine
  modified_base (14)..(14): 2'O-Methyl-cytosine
  modified_base (16)..(17): 2'O-Methyl-cytosine
  misc_feature (18)..(19): Phosphorothioate linkage
  misc_feature (19)..(20): Phosphorothioate linkage
  misc_feature (20)..(21): Phosphorothioate linkage
gcggaucaaaccucaccaatt

SEQ ID NO: 987 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  misc_feature (2)..(3): Phosphorothioate linkage
  misc_feature (18)..(19): Phosphorothioate linkage
  misc_feature (19)..(20): Phosphorothioate linkage
  misc_feature (20)..(21): Phosphorothioate linkage
gcggaucaaaccucaccaatt

SEQ ID NO: 988 - DNA, 20 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 5-Methyl-2'-Fluoro-uridine
  misc_feature (2)..(3): Phosphorothioate linkage
  modified_base (5)..(5): 5-Methyl-2'-Fluoro-uridine
  modified_base (12)..(12): 5-Methyl-2'-Fluoro-uridine
  misc_feature (17)..(18): Phosphorothioate linkage
  misc_feature (18)..(19): Phosphorothioate linkage
  misc_feature (19)..(20): Phosphorothioate linkage
uuggugagguuugaucgctt

SEQ ID NO: 989 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 2'Fluoro-uracil
  misc_feature (2)..(3): Phosphorothioate linkage
  modified_base (5)..(5): 5-Methyl-2'-Fluoro-uridine
  modified_base (11)..(12): 5-Methyl-2'-Fluoro-uridine
  misc_feature (18)..(19): Phosphorothioate linkage
  misc_feature (19)..(20): Phosphorothioate linkage
  misc_feature (20)..(21): Phosphorothioate linkage
uuggugagguuugauccgctt

SEQ ID NO: 990 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 5-Methyl-2'-Fluoro-uridine
  misc_feature (2)..(3): Phosphorothioate linkage
  modified_base (5)..(5): 5-Methyl-2'-Fluoro-uridine
  modified_base (10)..(11): 5-Methyl-2'-Fluoro-uridine
  misc_feature (18)..(19): Phosphorothioate linkage
  misc_feature (19)..(20): Phosphorothioate linkage
  misc_feature (20)..(21): Phosphorothioate linkage
uuggugagguuugauccgctt

SEQ ID NO: 991 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  modified_base (2)..(2): 2'O-Methyl-uracil
  misc_feature (2)..(3): Phosphorothioate linkage
  modified_base (5)..(5): 2'O-Methyl-uracil
  modified_base (11)..(12): 5-Methyl-2'-Fluoro-uridine
  misc_feature (18)..(19): Phosphorothioate linkage
  misc_feature (19)..(20): Phosphorothioate linkage
  misc_feature (20)..(21): Phosphorothioate linkage
uuggugagguuugauccgctt

SEQ ID NO: 992 - RNA, 21 nt, Artificial Sequence
  Description of Artificial Sequence: Synthetic oligonucleotide
  misc_feature (1)..(2): Phosphorothioate linkage
  modified_base (2)..(2): 2'O-Methyl-cytosine
  modified_base (4)..(4): 2'O-Methyl-cytosine
  modified_base (6)..(6): 2'O-Methyl-uracil
  modified_base (15)..(15): 2'O-Methyl-uracil
  modified_base (20)..(20): 2'O-Methyl-uracil
  misc_feature (20)..(21): Phosphorothioate linkage
gcacauaggagagaugagcuu

SEQ ID NO: 993 - RNA, 19 nt, Artificial Sequence
  Description of Artificial Sequence: Synthetic oligonucleotide
  misc_feature (1)..(2): Phosphorothioate linkage
  misc_feature (2)..(3): Phosphorothioate linkage
  misc_feature (3)..(4): Phosphorothioate linkage
  misc_feature (4)..(5): Phosphorothioate linkage
  misc_feature (5)..(6): Phosphorothioate linkage
  misc_feature (6)..(7): Phosphorothioate linkage
  misc_feature (7)..(8): Phosphorothioate linkage
  misc_feature (8)..(9): Phosphorothioate linkage
  misc_feature (9)..(10): Phosphorothioate linkage
  misc_feature (10)..(11): Phosphorothioate linkage
  misc_feature (11)..(12): Phosphorothioate linkage
  misc_feature (12)..(13): Phosphorothioate linkage
  misc_feature (13)..(14): Phosphorothioate linkage
  misc_feature (14)..(15): Phosphorothioate linkage
  misc_feature (15)..(16): Phosphorothioate linkage
  misc_feature (16)..(17): Phosphorothioate linkage
  misc_feature (17)..(18): Phosphorothioate linkage
  misc_feature (18)..(19): Phosphorothioate linkage
agcuuaaccuguccuucaa

SEQ ID NO: 994 - RNA, 19 nt, Artificial Sequence
  Description of Artificial Sequence: Synthetic oligonucleotide
  misc_feature (1)..(2): Phosphorothioate linkage
  misc_feature (2)..(3): Phosphorothioate linkage
  misc_feature (3)..(4): Phosphorothioate linkage
  misc_feature (4)..(5): Phosphorothioate linkage
  misc_feature (5)..(6): Phosphorothioate linkage
  misc_feature (6)..(7): Phosphorothioate linkage
  misc_feature (7)..(8): Phosphorothioate linkage
  misc_feature (8)..(9): Phosphorothioate linkage
  misc_feature (9)..(10): Phosphorothioate linkage
  misc_feature (10)..(11): Phosphorothioate linkage
  misc_feature (11)..(12): Phosphorothioate linkage
  misc_feature (12)..(13): Phosphorothioate linkage
  misc_feature (13)..(14): Phosphorothioate linkage
  misc_feature (14)..(15): Phosphorothioate linkage
  misc_feature (15)..(16): Phosphorothioate linkage
  misc_feature (16)..(17): Phosphorothioate linkage
  misc_feature (17)..(18): Phosphorothioate linkage
  misc_feature (18)..(19): Phosphorothioate linkage
uugaaggacagguuaagcu

SEQ ID NO: 995 - RNA, 23 nt, Artificial Sequence
  Description of Artificial Sequence: Synthetic oligonucleotide
  misc_feature (1)..(2): Phosphorothioate linkage
  modified_base (6)..(6): 2'O-Methyl-cytosine
  modified_base (15)..(15): 2'O-Methyl-uracil
  modified_base (17)..(17): 2'O-Methyl-uracil
  modified_base (19)..(19): 2'O-Methyl-uracil
  modified_base (21)..(21): 2'O-Methyl-cytosine
  modified_base (22)..(22): 2'O-Methyl-uracil
  misc_feature (22)..(23): Phosphorothioate linkage
aagcucaucucuccuaugugcug

SEQ ID NO: 996 - RNA, 21 nt, Artificial Sequence
  Description of Artificial Sequence: Synthetic oligonucleotide
  5' Conjugation to aminooxy-linker
  misc_feature (20)..(21): Phosphorothioate linkage
gcacauaggagagaugagcuu

SEQ ID NO: 997 - RNA, 21 nt, Artificial Sequence
  Description of Artificial Sequence: Synthetic oligonucleotide
  misc_feature (1)..(2): Phosphorothioate linkage
  misc_feature (20)..(21): Phosphorothioate linkage
gcacauaggagagaugagcuu

SEQ ID NO: 998 - RNA, 23 nt, Artificial Sequence
  Description of Artificial Sequence: Synthetic oligonucleotide
  misc_feature (1)..(2): Phosphorothioate linkage
  misc_feature (22)..(23): Phosphorothioate linkage
aagcucaucucuccuaugugcug

SEQ ID NO: 999 - RNA, 21 nt, Artificial Sequence
  Description of Artificial Sequence: Synthetic oligonucleotide
  misc_feature (1)..(2): Phosphorothioate linkage
  modified_base (6)..(6): 2'O-Methyl-uracil
  misc_feature (20)..(21): Phosphorothioate linkage
gcacauaggagagaugagcuu

SEQ ID NO: 1000 - RNA, 23 nt, Artificial Sequence
  Description of Artificial Sequence: Synthetic oligonucleotide
  misc_feature (1)..(2): Phosphorothioate linkage
  modified_base (21)..(21): 2'O-Methyl-cytosine
  modified_base (22)..(22): 2'O-Methyl-uracil
  misc_feature (22)..(23): Phosphorothioate linkage
aagcucaucucuccuaugugcug

SEQ ID NO: 1001 - RNA, 21 nt, Artificial Sequence
  Description of Artificial Sequence: Synthetic oligonucleotide
  modified_base (2)..(2): 2'O-Methyl-cytosine
  modified_base (4)..(4): 2'O-Methyl-cytosine
  modified_base (6)..(6): 2'O-Methyl-uracil
  modified_base (15)..(15): 2'O-Methyl-uracil
  modified_base (20)..(20): 2'O-Methyl-uracil
  misc_feature (20)..(21): Phosphorothioate linkage
gcacauaggagagaugagcuu

SEQ ID NO: 1002 - RNA, 23 nt, Artificial Sequence
  Description of Artificial Sequence: Synthetic oligonucleotide
  misc_feature (1)..(2): Phosphorothioate linkage
  modified_base (15)..(15): 2'O-Methyl-uracil
  modified_base (20)..(20): 2'O-Methyl-guanine
  modified_base (21)..(21): 2'O-Methyl-cytosine
  modified_base (22)..(22): 2'O-Methyl-uracil
  misc_feature (22)..(23): Phosphorothioate linkage
aagcucaucucuccuaugugcug

SEQ ID NO: 1003 - RNA, 21 nt, Artificial Sequence
  Description of Artificial Sequence: Synthetic oligonucleotide
  modified_base (6)..(6): 2'O-Methyl-uracil
  modified_base (15)..(15): 2'O-Methyl-uracil
  modified_base (20)..(20): 2'O-Methyl-uracil
  misc_feature (20)..(21): Phosphorothioate linkage
gcacauaggagagaugagcuu

SEQ ID NO: 1004 - RNA, 23 nt, Artificial Sequence
  Description of Artificial Sequence: Synthetic oligonucleotide
  modified_base (6)..(6): 2'O-Methyl-cytosine
  modified_base (15)..(15): 2'O-Methyl-uracil
  modified_base (17)..(17): 2'O-Methyl-uracil
  modified_base (19)..(19): 2'O-Methyl-uracil
  modified_base (22)..(22): 2'O-Methyl-uracil
  misc_feature (22)..(23): Phosphorothioate linkage
aagcucaucucuccuaugugcug

SEQ ID NO: 1005 - RNA, 21 nt, Artificial Sequence
  Description of Artificial Sequence: Synthetic oligonucleotide
  misc_feature (1)..(2): Phosphorothioate linkage
  modified_base (6)..(6): 2'Fluoro-uracil
  misc_feature (20)..(21): Phosphorothioate linkage
gcacauaggagagaugagcuu

SEQ ID NO: 1006 - RNA, 23 nt, Artificial Sequence
  Description of Artificial Sequence: Synthetic oligonucleotide
  modified_base (6)..(6): 2'O-Methyl-cytosine
  modified_base (15)..(15): 2'O-Methyl-uracil
  modified_base (17)..(17): 2'O-Methyl-uracil
  modified_base (19)..(19): 2'O-Methyl-uracil
  modified_base (21)..(21): 2'O-Methyl-cytosine
  modified_base (22)..(22): 2'O-Methyl-uracil
  misc_feature (22)..(23): Phosphorothioate linkage
aagcucaucucuccuaugugcug

SEQ ID NO: 1007 - RNA, 21 nt, Artificial Sequence
  Description of Artificial Sequence: Synthetic oligonucleotide
  modified_base (2)..(2): 2'Fluoro-cytosine
  modified_base (4)..(4): 2'Fluoro-cytosine
  modified_base (6)..(6): 2'Fluoro-uracil
  modified_base (15)..(15): 2'Fluoro-uracil
  modified_base (20)..(20): 2'Fluoro-uracil
  misc_feature (20)..(21): Phosphorothioate linkage
gcacauaggagagaugagcuu

SEQ ID NO: 1008 - RNA, 23 nt, Artificial Sequence
  Description of Artificial Sequence: Synthetic oligonucleotide
  modified_base (15)..(15): 2'O-Methyl-uracil
  modified_base (17)..(17): 2'O-Methyl-uracil
  modified_base (19)..(19): 2'O-Methyl-uracil
  modified_base (22)..(22): 2'O-Methyl-uracil
  misc_feature (22)..(23): Phosphorothioate linkage
aagcucaucucuccuaugugcug

SEQ ID NO: 1009 - RNA, 21 nt, Artificial Sequence
  Description of Artificial Sequence: Synthetic oligonucleotide
  modified_base (2)..(2): 2'Fluoro-cytosine
  modified_base (4)..(4): 2'Fluoro-cytosine
  modified_base (6)..(6): 2'O-Methyl-uracil
  modified_base (15)..(15): 2'O-Methyl-uracil
  modified_base (20)..(20): 2'O-Methyl-uracil
  misc_feature (20)..(21): Phosphorothioate linkage
gcacauaggagagaugagcuu

SEQ ID NO: 1010 - RNA, 23 nt, Artificial Sequence
  Description of Artificial Sequence: Synthetic oligonucleotide
  modified_base (6)..(6): 2'Fluoro-cytosine
  modified_base (15)..(15): 2'Fluoro-uracil
  modified_base (17)..(17): 2'Fluoro-uracil
  modified_base (19)..(19): 2'Fluoro-uracil
  modified_base (22)..(22): 2'Fluoro-uracil
  misc_feature (22)..(23): Phosphorothioate linkage
aagcucaucucuccuaugugcug

SEQ ID NO: 1011 - RNA, 21 nt, Artificial Sequence
  Description of Artificial Sequence: Synthetic oligonucleotide
  modified_base (2)..(2): 2'O-Methyl-cytosine
  modified_base (4)..(4): 2'O-Methyl-cytosine
  modified_base (6)..(6): 2'Fluoro-uracil
  modified_base (15)..(15): 2'Fluoro-uracil
  modified_base (20)..(20): 2'Fluoro-uracil
  misc_feature (20)..(21): Phosphorothioate linkage
gcacauaggagagaugagcuu

SEQ ID NO: 1012 - RNA, 23 nt, Artificial Sequence
  Description of Artificial Sequence: Synthetic oligonucleotide
  modified_base (6)..(6): 2'O-Methyl-cytosine
  modified_base (15)..(15): 2'Fluoro-uracil
  modified_base (17)..(17): 2'Fluoro-uracil
  modified_base (19)..(19): 2'Fluoro-uracil
  modified_base (22)..(22): 2'Fluoro-uracil
  misc_feature (22)..(23): Phosphorothioate linkage
aagcucaucucuccuaugugcug

SEQ ID NO: 1013 - RNA, 21 nt, Artificial Sequence
  Description of Artificial Sequence: Synthetic oligonucleotide
  modified_base (2)..(2): 2'O-Methyl-cytosine
  modified_base (4)..(4): 2'O-Methyl-cytosine
  modified_base (6)..(6): 2'Fluoro-uracil
  modified_base (15)..(15): 2'Fluoro-uracil
  modified_base (20)..(20): 2'Fluoro-uracil
  misc_feature (20)..(21): Phosphorothioate linkage
gcacauaggagagaugagcuu

SEQ ID NO: 1014 - RNA, 23 nt, Artificial Sequence
  Description of Artificial Sequence: Synthetic oligonucleotide
  modified_base (6)..(6): 2'Fluoro-cytosine
  modified_base (15)..(15): 2'O-Methyl-uracil
  modified_base (17)..(17): 2'O-Methyl-uracil
  modified_base (19)..(19): 2'O-Methyl-uracil
  modified_base (22)..(22): 2'O-Methyl-uracil
  misc_feature (22)..(23): Phosphorothioate linkage
aagcucaucucuccuaugugcug

SEQ ID NO: 1015 - RNA, 21 nt, Artificial Sequence
  Description of Artificial Sequence: Synthetic oligonucleotide
  modified_base (2)..(2): 2'O-Methyl-cytosine
  modified_base (4)..(4): 2'O-Methyl-cytosine
  modified_base (6)..(6): 2'O-Methyl-uracil
  modified_base (8)..(8): 2'O-Methyl-guanine
  modified_base (10)..(10): 2'O-Methyl-adenine
  modified_base (12)..(12): 2'O-Methyl-adenine
  modified_base (14)..(14): 2'O-Methyl-adenine
  modified_base (16)..(16): 2'O-Methyl-guanine
  modified_base (18)..(18): 2'O-Methyl-guanine
  modified_base (20)..(20): 2'O-Methyl-uracil
  misc_feature (20)..(21): Phosphorothioate linkage
gcacauaggagagaugagcuu

SEQ ID NO: 1016 - RNA, 23 nt, Artificial Sequence
  Description of Artificial Sequence: Synthetic oligonucleotide
  modified_base (1)..(1): 2'O-Methyl-adenine
  modified_base (3)..(3): 2'O-Methyl-guanine
  modified_base (5)..(5): 2'O-Methyl-uracil
  modified_base (7)..(7): 2'O-Methyl-adenine
  modified_base (9)..(9): 2'O-Methyl-cytosine
  modified_base (11)..(11): 2'O-Methyl-cytosine
  modified_base (13)..(13): 2'O-Methyl-cytosine
  modified_base (15)..(15): 2'O-Methyl-uracil
  modified_base (17)..(17): 2'O-Methyl-uracil
  modified_base (19)..(19): 2'O-Methyl-uracil
  modified_base (21)..(21): 2'O-Methyl-cytosine
  misc_feature (22)..(23): Phosphorothioate linkage
  modified_base (23)..(23): 2'O-Methyl-guanine
aagcucaucucuccuaugugcug

SEQ ID NO: 1017 - RNA, 19 nt, Artificial Sequence
  Description of Artificial Sequence: Synthetic oligonucleotide
gcacauaggagagaugagc

SEQ ID NO: 1018 - RNA, 19 nt, Artificial Sequence
  Description of Artificial Sequence: Synthetic oligonucleotide
gcucaucucuccuaugugc

SEQ ID NO: 1019 - DNA, 21 bp, Artificial Sequence
  Description of Combined DNA/RNA molecule: Synthetic oligonucleotide
  Description of Artificial Sequence: Synthetic oligonucleotide
cccugguggacaucuuccatt

SEQ ID NO: 1020 - DNA, 21 bp, Artificial Sequence
  Description of Combined DNA/RNA molecule: Synthetic oligonucleotide
  Description of Artificial Sequence: Synthetic oligonucleotide
uggaagauguccaccagggtt

SEQ ID NO: 1021 - DNA, 21 bp, Artificial Sequence
  Description of Combined DNA/RNA molecule: Synthetic oligonucleotide
  Description of Artificial Sequence: Synthetic oligonucleotide
  modified_base (1)..(3): 2'O-Methyl-cytosine
  modified_base (4)..(4): 2'O-Methyl-uracil
  modified_base (7)..(7): 2'O-Methyl-uracil
  modified_base (11)..(11): 2'O-Methyl-cytosine
  modified_base (13)..(13): 2'O-Methyl-uracil
  modified_base (14)..(14): 2'O-Methyl-cytosine
  modified_base (15)..(16): 2'O-Methyl-uracil
  modified_base (17)..(18): 2'O-Methyl-cytosine
  misc_feature (20)..(21): Phosphorothioate linkage
cccugguggacaucuuccatt

SEQ ID NO: 1022 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'Fluoro-uracil
  modified_base (8)..(8): 2'Fluoro-uracil
  modified_base (10)..(10): 2'Fluoro-uracil
  modified_base (11)..(12): 2'Fluoro-cytosine
  modified_base (14)..(15): 2'Fluoro-cytosine
  misc_feature (20)..(21): Phosphorothioate linkage
uggaagauguccaccagggtt

SEQ ID NO: 1023 - DNA, 21 bp, Artificial Sequence
  Description of Combined DNA/RNA molecule: Synthetic oligonucleotide
  Description of Artificial Sequence: Synthetic oligonucleotide
  5' Conjugation to cholesterol
  modified_base (1)..(3): 2'O-Methyl-cytosine
  modified_base (4)..(4): 2'O-Methyl-uracil
  modified_base (7)..(7): 2'O-Methyl-uracil
  modified_base (11)..(11): 2'O-Methyl-cytosine
  modified_base (13)..(13): 2'O-Methyl-uracil
  modified_base (14)..(14): 2'O-Methyl-cytosine
  modified_base (15)..(16): 2'O-Methyl-uracil
  modified_base (17)..(18): 2'O-Methyl-cytosine
  misc_feature (20)..(21): Phosphorothioate linkage
cccugguggacaucuuccatt

SEQ ID NO: 1024 - DNA, 21 bp, Artificial Sequence
  Description of Combined DNA/RNA molecule: Synthetic oligonucleotide
  Description of Artificial Sequence: Synthetic oligonucleotide
  5' Conjugation to cholesterol through a phosphorothioate linkage
  modified_base (1)..(3): 2'O-Methyl-cytosine
  modified_base (4)..(4): 2'O-Methyl-uracil
  modified_base (7)..(7): 2'O-Methyl-uracil
  modified_base (11)..(11): 2'O-Methyl-cytosine
  modified_base (13)..(13): 2'O-Methyl-uracil
  modified_base (14)..(14): 2'O-Methyl-cytosine
  modified_base (15)..(16): 2'O-Methyl-uracil
  modified_base (17)..(18): 2'O-Methyl-cytosine
  misc_feature (20)..(21): Phosphorothioate linkage
cccugguggacaucuuccatt

SEQ ID NO: 1025 - DNA, 21 bp, Artificial Sequence
  Description of Combined DNA/RNA molecule: Synthetic oligonucleotide
  Description of Artificial Sequence: Synthetic oligonucleotide
accaugcagauuaugcggatt

SEQ ID NO: 1026 - DNA, 21 bp, Artificial Sequence
  Description of Combined DNA/RNA molecule: Synthetic oligonucleotide
  Description of Artificial Sequence: Synthetic oligonucleotide
uccgcauaaucugcauggutt

SEQ ID NO: 1027 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-adenine
  modified_base (3)..(3): 2'O-Methyl-cytosine
  modified_base (5)..(5): 2'O-Methyl-uracil
  modified_base (7)..(7): 2'O-Methyl-cytosine
  modified_base (11)..(12): 2'O-Methyl-uracil
  modified_base (14)..(14): 2'O-Methyl-uracil
  modified_base (16)..(16): 2'O-Methyl-cytosine
  misc_feature (20)..(21): Phosphorothioate linkage
accaugcagauuaugcggatt

SEQ ID NO: 1028 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'Fluoro-uracil
  modified_base (2)..(3): 2'Fluoro-cytosine
  modified_base (5)..(5): 2'Fluoro-cytosine
  modified_base (7)..(7): 2'Fluoro-uracil
  modified_base (10)..(10): 2'Fluoro-uracil
  modified_base (11)..(11): 2'Fluoro-cytosine
  modified_base (12)..(12): 2'Fluoro-uracil
  modified_base (14)..(14): 2'Fluoro-cytosine
  modified_base (16)..(16): 2'Fluoro-uracil
  modified_base (19)..(19): 2'Fluoro-uracil
  misc_feature (20)..(21): Phosphorothioate linkage
uccgcauaaucugcauggutt

SEQ ID NO: 1029 - DNA, 21 bp, Artificial Sequence
  Description of Combined DNA/RNA molecule: Synthetic oligonucleotide
  Description of Artificial Sequence: Synthetic oligonucleotide
  5' Conjugation to cholesterol
  modified_base (1)..(1): 2'O-Methyl-adenine
  modified_base (3)..(3): 2'O-Methyl-cytosine
  modified_base (5)..(5): 2'O-Methyl-uracil
  modified_base (7)..(7): 2'O-Methyl-cytosine
  modified_base (11)..(12): 2'O-Methyl-uracil
  modified_base (14)..(14): 2'O-Methyl-uracil
  modified_base (16)..(16): 2'O-Methyl-cytosine
  misc_feature (20)..(21): Phosphorothioate linkage
accaugcagauuaugcggatt

SEQ ID NO: 1030 - DNA, 21 bp, Artificial Sequence
  Description of Combined DNA/RNA molecule: Synthetic oligonucleotide
  Description of Artificial Sequence: Synthetic oligonucleotide
cauaggagagaugagcuuctt

SEQ ID NO: 1031 - DNA, 21 bp, Artificial Sequence
  Description of Combined DNA/RNA molecule: Synthetic oligonucleotide
  Description of Artificial Sequence: Synthetic oligonucleotide
gaagcucaucucuccuaugtt

SEQ ID NO: 1032 - DNA, 21 bp, Artificial Sequence
  Description of Combined DNA/RNA molecule: Synthetic oligonucleotide
  Description of Artificial Sequence: Synthetic oligonucleotide
  modified_base (3)..(3): 2'O-Methyl-uracil
  modified_base (12)..(12): 2'O-Methyl-uracil
  modified_base (16)..(16): 2'O-Methyl-cytosine
  modified_base (17)..(18): 2'O-Methyl-uracil
  modified_base (19)..(19): 2'O-Methyl-cytosine
  misc_feature (20)..(21): Phosphorothioate linkage
cauaggagagaugagcuuctt

SEQ ID NO: 1033 - DNA, 21 bp, Artificial Sequence
  Description of Combined DNA/RNA molecule: Synthetic oligonucleotide
  Description of Artificial Sequence: Synthetic oligonucleotide
  modified_base (5)..(5): 2'O-Methyl-cytosine
  modified_base (6)..(6): 2'O-Methyl-uracil
  modified_base (9)..(9): 2'O-Methyl-uracil
  modified_base (10)..(10): 2'O-Methyl-cytosine
  modified_base (11)..(11): 2'O-Methyl-uracil
  modified_base (12)..(12): 2'O-Methyl-cytosine
  modified_base (13)..(13): 2'O-Methyl-uracil
  modified_base (14)..(15): 2'O-Methyl-cytosine
  modified_base (16)..(16): 2'O-Methyl-uracil
  modified_base (18)..(18): 2'O-Methyl-uracil
gaagcucaucucuccuaugtt

SEQ ID NO: 1034 - DNA, 21 bp, Artificial Sequence
  Description of Combined DNA/RNA molecule: Synthetic oligonucleotide
  Description of Artificial Sequence: Synthetic oligonucleotide
  5' Conjugation to cholesterol
  modified_base (3)..(3): 2'O-Methyl-uracil
  modified_base (12)..(12): 2'O-Methyl-uracil
  modified_base (16)..(16): 2'O-Methyl-cytosine
  modified_base (17)..(18): 2'O-Methyl-uracil
  modified_base (19)..(19): 2'O-Methyl-cytosine
  misc_feature (20)..(21): Phosphorothioate linkage
cauaggagagaugagcuuctt

SEQ ID NO: 1035 - DNA, 21 bp, Artificial Sequence
  Description of Combined DNA/RNA molecule: Synthetic oligonucleotide
  Description of Artificial Sequence: Synthetic oligonucleotide
  modified_base (5)..(5): 2'O-Methyl-cytosine
  modified_base (6)..(6): 2'O-Methyl-uracil
  modified_base (9)..(9): 2'O-Methyl-uracil
  modified_base (10)..(10): 2'O-Methyl-cytosine
  modified_base (11)..(11): 2'O-Methyl-uracil
  modified_base (12)..(12): 2'O-Methyl-cytosine
  modified_base (13)..(13): 2'O-Methyl-uracil
  modified_base (14)..(15): 2'O-Methyl-cytosine
  modified_base (16)..(16): 2'O-Methyl-uracil
  modified_base (18)..(18): 2'O-Methyl-uracil
gaagcucaucucuccuaugtt

SEQ ID NO: 1036 - DNA, 21 bp, Artificial Sequence
  Description of Combined DNA/RNA molecule: Synthetic oligonucleotide
  Description of Artificial Sequence: Synthetic oligonucleotide
  modified_base (1)..(1): 2'O-Methyl-cytosine
  modified_base (3)..(3): 2'O-Methyl-uracil
  modified_base (12)..(12): 2'O-Methyl-uracil
  misc_feature (20)..(21): Phosphorothioate linkage
cauaggagagaugagcuuctt

SEQ ID NO: 1037 - DNA, 21 bp, Artificial Sequence
  Description of Combined DNA/RNA molecule: Synthetic oligonucleotide
  Description of Artificial Sequence: Synthetic oligonucleotide
  modified_base (7)..(7): 2'O-Methyl-cytosine
  modified_base (16)..(16): 2'O-Methyl-uracil
  modified_base (18)..(18): 2'O-Methyl-uracil
  misc_feature (20)..(21): Phosphorothioate linkage
gaagcucaucucuccuaugtt

SEQ ID NO: 1038 - RNA, 21 nt, Artificial Sequence
  Description of Artificial Sequence: Synthetic oligonucleotide
gugaaugcagaccaaagaaag

SEQ ID NO: 1039 - RNA, 23 nt, Artificial Sequence
  Description of Artificial Sequence: Synthetic oligonucleotide
cuuucuuuggucugcauucacau

SEQ ID NO: 1040 - RNA, 19 nt, Artificial Sequence
  Description of Artificial Sequence: Synthetic oligonucleotide
gugaaugcagaccaaagaa

SEQ ID NO: 1041 - RNA, 19 nt, Artificial Sequence
  Description of Artificial Sequence: Synthetic oligonucleotide
uucuuuggucugcauucac

SEQ ID NO: 1042 - RNA, 21 nt, Artificial Sequence
  Description of Artificial Sequence: Synthetic oligonucleotide
cuuucuuuggucugcauucac

SEQ ID NO: 1043 - RNA, 21 nt, Artificial Sequence
  Description of Artificial Sequence: Synthetic oligonucleotide
  modified_base (2)..(2): 2'O-Methyl-uracil
  modified_base (6)..(6): 2'O-Methyl-uracil
  modified_base (8)..(8): 2'O-Methyl-cytosine
  modified_base (13)..(13): 2'O-Methyl-cytosine
  misc_feature (20)..(21): Phosphorothioate linkage
gugaaugcagaccaaagaaag

SEQ ID NO: 1044 - RNA, 23 nt, Artificial Sequence
  Description of Artificial Sequence: Synthetic oligonucleotide
  modified_base (8)..(8): 2'O-Methyl-uracil
  modified_base (13)..(13): 2'O-Methyl-uracil
  modified_base (15)..(15): 2'O-Methyl-cytosine
  modified_base (19)..(19): 2'O-Methyl-cytosine
  misc_feature (22)..(23): Phosphorothioate linkage
cuuucuuuggucugcauucacau

SEQ ID NO: 1045 - RNA, 21 nt, Artificial Sequence
  Description of Artificial Sequence: Synthetic oligonucleotide
gcggaucaaaccucaccaagg

SEQ ID NO: 1046 - RNA, 21 nt, Artificial Sequence
  Description of Artificial Sequence: Synthetic oligonucleotide
ccuuggugagguuugauccgc

SEQ ID NO: 1047 - RNA, 19 nt, Artificial Sequence
  Description of Artificial Sequence: Synthetic oligonucleotide
gcggaucaaaccucaccaa

SEQ ID NO: 1048 - RNA, 19 nt, Artificial Sequence
  Description of Artificial Sequence: Synthetic oligonucleotide
uuggugagguuugauccgc

SEQ ID NO: 1049 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  misc_feature (2)..(3): Phosphorothioate linkage
  misc_feature (18)..(19): Phosphorothioate linkage
  misc_feature (19)..(20): Phosphorothioate linkage
  misc_feature (20)..(21): Phosphorothioate linkage
gcggaucaaaccucaccaatt

SEQ ID NO: 1050 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  misc_feature (2)..(3): Phosphorothioate linkage
  misc_feature (18)..(19): Phosphorothioate linkage
  misc_feature (19)..(20): Phosphorothioate linkage
  misc_feature (20)..(21): Phosphorothioate linkage
uuggugagguuugauccgctt

SEQ ID NO: 1051 - DNA, 21 bp, Artificial Sequence
  Description of Combined DNA/RNA molecule: Synthetic oligonucleotide
  Description of Artificial Sequence: Synthetic oligonucleotide
gcacauaggagagaugagctt

SEQ ID NO: 1052 - DNA, 21 bp, Artificial Sequence
  Description of Combined DNA/RNA molecule: Synthetic oligonucleotide
  Description of Artificial Sequence: Synthetic oligonucleotide
gcucaucucuccuaugugctt

SEQ ID NO: 1053 - RNA, 21 nt, Artificial Sequence
  Description of Artificial Sequence: Synthetic oligonucleotide
gcacauaggagagaugagcuu

SEQ ID NO: 1054 - RNA, 21 nt, Artificial Sequence
  Description of Artificial Sequence: Synthetic oligonucleotide
aagcucaucucuccuaugugc

SEQ ID NO: 1055 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  misc_feature (19)..(20): Phosphorothioate linkage
  misc_feature (20)..(21): Phosphorothioate linkage
gcacauaggagagaugagctt

SEQ ID NO: 1056 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  misc_feature (2)..(3): Phosphorothioate linkage
  misc_feature (18)..(19): Phosphorothioate linkage
  misc_feature (19)..(20): Phosphorothioate linkage
  misc_feature (20)..(21): Phosphorothioate linkage
gcacauaggagagaugagctt

SEQ ID NO: 1057 - RNA, 21 nt, Artificial Sequence
  Description of Artificial Sequence: Synthetic oligonucleotide
ggacaucuuccaggaguaccc

SEQ ID NO: 1058 - RNA, 23 nt, Artificial Sequence
  Description of Artificial Sequence: Synthetic oligonucleotide
ggguacuccuggaagauguccac

SEQ ID NO: 1059 - RNA, 19 nt, Artificial Sequence
  Description of Artificial Sequence: Synthetic oligonucleotide
ggacaucuuccaggaguac

SEQ ID NO: 1060 - RNA, 19 nt, Artificial Sequence
  Description of Artificial Sequence: Synthetic oligonucleotide
guacuccuggaagaugucc

SEQ ID NO: 1061 - RNA, 21 nt, Artificial Sequence
  Description of Artificial Sequence: Synthetic oligonucleotide
ggguacuccuggaagaugucc

SEQ ID NO: 1062 - RNA, 21 nt, Artificial Sequence
  Description of Artificial Sequence: Synthetic oligonucleotide
gcacauagaagugacgcgcuu

SEQ ID NO: 1063 - RNA, 23 nt, Artificial Sequence
  Description of Artificial Sequence: Synthetic oligonucleotide
aagcgcgucacuucuaugugcug

SEQ ID NO: 1064 - RNA, 23 nt, Artificial Sequence
  Description of Artificial Sequence: Synthetic oligonucleotide
aaccacaacuguccaaugugcug

SEQ ID NO: 1065 - RNA, 21 nt, Artificial Sequence
  Description of Artificial Sequence: Synthetic oligonucleotide
gcacauuggacaguugugguu

SEQ ID NO: 1066 - RNA, 21 nt, Artificial Sequence
  Description of Artificial Sequence: Synthetic oligonucleotide
  5' Conjugation to all-trans-retinal-aminooxy
  misc_feature (20)..(21): Phosphorothioate linkage
gcacauaggagagaugagcuu

SEQ ID NO: 1067 - RNA, 21 nt, Artificial Sequence
  Description of Artificial Sequence: Synthetic oligonucleotide
  5' Conjugation to 4-keto-retinol
  modified_base (20)..(21): Phosphorothioate linkage
gcacauaggagagaugagcuu

SEQ ID NO: 1068 - RNA, 21 nt, Artificial Sequence
  Description of Artificial Sequence: Synthetic oligonucleotide
  5' Conjugation to aminooxy-linker
  misc_feature (20)..(21): Phosphorothioate linkage
gaacugugugugagagguccu

SEQ ID NO: 1069 - RNA, 21 nt, Artificial Sequence
  Description of Artificial Sequence: Synthetic oligonucleotide
  5' Conjugation to all-trans-retinal-aminooxy
  misc_feature (20)..(21): Phosphorothioate linkage
gaacugugugugagagguccu

SEQ ID NO: 1070 - RNA, 21 nt, Artificial Sequence
  Description of Artificial Sequence: Synthetic oligonucleotide
  5' Conjugation to 1-pyrene-carboxaldehyde-aminooxy
  misc_feature (20)..(21): Phosphorothioate linkage
gaacugugugugagagguccu

SEQ ID NO: 1071 - RNA, 21 nt, Artificial Sequence
  Description of Artificial Sequence: Synthetic oligonucleotide
  3' Conjugation to polyethylene glycol (20K) through a hydroxyprolinol linker via a phosphorothioate linkage
gcacauaggagagaugacguu

SEQ ID NO: 1072 - RNA, 21 nt, Artificial Sequence
  Description of Artificial Sequence: Synthetic oligonucleotide
  misc_feature (1)..(2): Phosphorothioate linkage
  3' Conjugation to polyethylene glycol (5K) through a hydroxyprolinol linker
gucaucacacugaauaccaau

SEQ ID NO: 1073 - RNA, 21 nt, Artificial Sequence
  Description of Artificial Sequence: Synthetic oligonucleotide
  misc_feature (1)..(2): Phosphorothioate linkage
  3' Conjugation to polyethylene glycol (20K) through a hydroxyprolinol linker
gucaucacacugaauaccaau

SEQ ID NO: 1074 - DNA, 21 bp, Artificial Sequence
  Description of Combined DNA/RNA molecule: Synthetic oligonucleotide
  Description of Artificial Sequence: Synthetic oligonucleotide
  5' Conjugation to polyethylene glycol (5K) through a hydroxyprolinol linker
  misc_feature (20)..(21): Phosphorothioate linkage
cuuacgcugaguacuucgatt

SEQ ID NO: 1075 - DNA, 21 bp, Artificial Sequence
  Description of Combined DNA/RNA molecule: Synthetic oligonucleotide
  Description of Artificial Sequence: Synthetic oligonucleotide
  5' Conjugation to polyethylene glycol (20K) through a hydroxyprolinol linker
  misc_feature (20)..(21): Phosphorothioate linkage
cuuacgcugaguacuucgatt

SEQ ID NO: 1076 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  3' Conjugation to polyethylene glycol (5K) through a hydroxyprolinol linker
cuuacgcugaguacuucgatt

SEQ ID NO: 1077 - DNA, 21 bp, Artificial Sequence
  Description of Combined DNA/RNA molecule: Synthetic oligonucleotide
  Description of Artificial Sequence: Synthetic oligonucleotide
  misc_feature (1)..(2): Phosphorothioate linkage
  3' Conjugation to polyethylene glycol (20K) through a hydroxyprolinol linker
cuuacgcugaguacuucgatt

SEQ ID NO: 1078 - DNA, 21 bp, Artificial Sequence
  Description of Combined DNA/RNA molecule: Synthetic oligonucleotide
  Description of Artificial Sequence: Synthetic oligonucleotide
  5' Conjugation to cholesterol through a phosphorothioate linkage
  modified_base (1)..(1): 2'O-Methyl-adenine
  modified_base (3)..(3): 2'O-Methyl-cytosine
  modified_base (5)..(5): 2'O-Methyl-uracil
  modified_base (7)..(7): 2'O-Methyl-cytosine
  modified_base (11)..(12): 2'O-Methyl-uracil
  modified_base (14)..(14): 2'O-Methyl-uracil
  modified_base (16)..(16): 2'O-Methyl-cytosine
  misc_feature (20)..(21): Phosphorothioate linkage
accaugcagauuaugcggatt

SEQ ID NO: 1079 - DNA, 21 bp, Artificial Sequence
  Description of Combined DNA/RNA molecule: Synthetic oligonucleotide
  Description of Artificial Sequence: Synthetic oligonucleotide
  5' Conjugation to cholesterol through a phosphorothioate linkage
  modified_base (3)..(3): 2'O-Methyl-uracil
  modified_base (12)..(12): 2'O-Methyl-uracil
  modified_base (16)..(16): 2'O-Methyl-cytosine
  modified_base (17)..(18): 2'O-Methyl-uracil
  modified_base (19)..(19): 2'O-Methyl-cytosine
  misc_feature (20)..(21): Phosphorothioate linkage
cauaggagagaugagcuuctt

SEQ ID NO: 1080 - RNA, 14 nt, Artificial Sequence
  Description of Artificial Sequence: Synthetic oligonucleotide
aggagagaugagcu

SEQ ID NO: 1081 - RNA, 15 nt, Artificial Sequence
  Description of Artificial Sequence: Synthetic oligonucleotide
aggagagaugagcuu

SEQ ID NO: 1082 - RNA, 15 nt, Artificial Sequence
  Description of Artificial Sequence: Synthetic oligonucleotide
aagcucaucucuccu

SEQ ID NO: 1083 - RNA, 20 nt, Artificial Sequence
  Description of Artificial Sequence: Synthetic oligonucleotide
gcacauaggagagaugagcu

SEQ ID NO: 1084 - RNA, 22 nt, Artificial Sequence
  Description of Artificial Sequence: Synthetic oligonucleotide
aagcucaucucuccuaugugcu

SEQ ID NO: 1085 - RNA, 21 nt, Artificial Sequence
  Description of Artificial Sequence: Synthetic oligonucleotide
  misc_feature (1)..(2): Phosphorothioate linkage
  modified_base (2)..(2): 2'O-Methyl-cytosine
  modified_base (4)..(4): 2'O-Methyl-cytosine
  modified_base (6)..(6): 2'O-Methyl-uracil
  modified_base (15)..(15): 2'O-Methyl-uracil
  modified_base (20)..(20): 2'O-Methyl-uracil
  misc_feature (20)..(21): Phosphorothioate linkage
gcacauaggagagaugagcuu

SEQ ID NO: 1086 - RNA, 21 nt, Artificial Sequence
  Description of Artificial Sequence: Synthetic oligonucleotide
  misc_feature (20)..(21): Phosphorothioate linkage
gcacauuggacaguugugguu

SEQ ID NO: 1087 - RNA, 23 nt, Artificial Sequence
  Description of Artificial Sequence: Synthetic oligonucleotide
  misc_feature (22)..(23): Phosphorothioate linkage
aaccacaacuguccaaugugcug

SEQ ID NO: 1088 - DNA, 12 bp, Artificial Sequence
  Description of Artificial Sequence: Synthetic oligonucleotide
tttttttttttt

We claim:

1. An isolated double stranded iRNA agent, consisting of SEQ ID NO:671 and SEQ ID NO:939.

2. An isolated double stranded iRNA agent, consisting of SEQ ID NO:671 and SEQ ID NO:939 and a non-nucleotide moiety.

3. An isolated double stranded iRNA agent, consisting of SEQ ID NO:671 and SEQ ID NO:939 and a 2'-modified nucleotide.

4. The iRNA agent of claim 3, wherein the 2'-modified nucleotide comprises a modification selected from the group consisting of: 2'-deoxy, 2'-deoxy-2'-fluoro, and 2'-O-methyl.

5. A method of reducing the amount of VEGF RNA in a cell of a subject, comprising contacting the cell with an iRNA agent of claim 1.

6. A pharmaceutical composition comprising an iRNA agent of claim 1 and a pharmaceutically acceptable carrier.

7. A method of inhibiting VEGF expression in a subject comprising administering to said subject an effective amount of an iRNA agent of claim 1.

* * * * *